United States Patent
Ekblad et al.

(10) Patent No.: US 10,167,322 B2
(45) Date of Patent: Jan. 1, 2019

(54) ENGINEERED ALBUMIN BINDING POLYPEPTIDE

(71) Applicant: AFFIBODY AB, Solna (SE)

(72) Inventors: Caroline Ekblad, Saltsjö-Boo (SE); Fredrik Frejd, Stockholm (SE); Joel Lindgren, Stockholm (SE); Amelie Eriksson Karlström, Bromma (SE)

(73) Assignee: AFFIBODY AB, Solna (SE)

( * ) Notice: Subject to any disclaimer, the term of this patent is extended or adjusted under 35 U.S.C. 154(b) by 0 days.

(21) Appl. No.: 15/104,070

(22) PCT Filed: Dec. 19, 2014

(86) PCT No.: PCT/EP2014/078756
§ 371 (c)(1),
(2) Date: Jun. 13, 2016

(87) PCT Pub. No.: WO2015/091957
PCT Pub. Date: Jun. 25, 2015

(65) Prior Publication Data
US 2016/0311863 A1    Oct. 27, 2016

(30) Foreign Application Priority Data
Dec. 20, 2013 (EP) ................... 13198808

(51) Int. Cl.
*C07K 14/315* (2006.01)
*C07K 14/76* (2006.01)
*A61K 38/00* (2006.01)

(52) U.S. Cl.
CPC ............ *C07K 14/315* (2013.01); *C07K 14/76* (2013.01); *A61K 38/00* (2013.01)

(58) Field of Classification Search
CPC ....... A61K 38/00; C07K 14/315; C07K 14/76
See application file for complete search history.

(56) References Cited

U.S. PATENT DOCUMENTS

| | | | |
|---|---|---|---|
| 6,362,225 | B1 | 3/2002 | Andreakos |
| 7,288,265 | B1 | 10/2007 | Rolf |
| 9,211,344 | B2 | 12/2015 | Eckblad et al. |
| 2003/0017203 | A1 | 1/2003 | Crotts et al. |
| 2004/0001827 | A1 | 1/2004 | Dennis |
| 2005/0215475 | A1 | 9/2005 | Ong et al. |
| 2005/0282756 | A1 | 12/2005 | Mehta et al. |
| 2007/0134279 | A1 | 6/2007 | Stern |
| 2009/0163408 | A1 | 6/2009 | Fogelman et al. |
| 2011/0014247 | A1 | 1/2011 | Kidron |
| 2011/0142800 | A1 | 6/2011 | Kidron et al. |
| 2013/0034597 | A1 | 2/2013 | Maggio |
| 2014/0162956 | A1 | 6/2014 | Ekblad |
| 2015/0098991 | A1 | 4/2015 | Bejker et al. |
| 2016/0009767 | A9 | 1/2016 | Bejker et al. |
| 2016/0108095 | A1 | 4/2016 | Ekblad et al. |

FOREIGN PATENT DOCUMENTS

| | | |
|---|---|---|
| CN | 101294187 A | 10/2008 |
| WO | 9101743 A1 | 2/1991 |
| WO | 9519374 A1 | 7/1995 |
| WO | 0145746 A2 | 6/2001 |
| WO | 2005087797 A1 | 9/2005 |
| WO | 2008043821 A1 | 4/2008 |
| WO | 2009016043 A2 | 2/2009 |
| WO | 2009080811 A1 | 7/2009 |
| WO | 2010054699 A1 | 5/2010 |
| WO | 2010141329 A1 | 12/2010 |
| WO | 2012004384 A2 | 1/2012 |
| WO | 2012016043 A2 | 2/2012 |
| WO | 2012050930 A2 | 4/2012 |
| WO | 2013009539 A1 | 1/2013 |
| WO | 2014048977 A1 | 4/2014 |

OTHER PUBLICATIONS

Aboud-Pirak, E. et al., "Cytotoxic Activity of Daunorubicin or Vindesin Conjugated to a Monoclonal Antibody on Cultured MCF-7 Breast Carconoma Cells", Biochemical Pharmacology, vol. 38, No. 4, (1989) pp. 641-648.
Bauss, F. et al., "Effect of 17B-Estradiol-Bisphosphonate Conjugates, Potential Bone-Seeking Estrogen Pro-Drugs, on 17B-Estradiol Serum Kinetics and Bone Mass in Rats", Calcif Tissue Int (1996) 59, pp. 168-173.
Bonora, G.M. et al., "Antisense activity of an anti-HIV oligonucleotide conjugated to linear and branched high molecular weight polyethylene glycols", Il Farmaco 53 (1998), pp. 634-637.
Guo, Neng-Hua et al., "Antiproliferative and antitumor activities of D-reverse peptides derived from the second type-1 repeat of thrombospondin-1", J. Peptide Res. 50, 1997, pp. 210-221.
"Arginine" [online], retrieved from the Internet on Aug. 7, 2017 <URL: http://www.russelllab.org/aas/Arg.html>(three pages) from M.J. Betts, R.B. Russell., Ch. 14. Amino acid properties and consequences of substitutions. In Bioinformatics for Geneticists, M.R. Barnes, I.C. Gray eds, Wiley, 2003.
"Lysine" [online], retrieved from the Internet on Aug. 7, 2017 <URL: http://www.russelllab.org/aas/Lys.html> (two pages) from M.J. Betts, R.B. Russell., Ch. 14. Amino acid properties and consequences of substitutions. In Bioinformatics for Geneticists, M.R. Barnes, I.C. Gray eds, Wiley, 2003.

(Continued)

*Primary Examiner* — Rachael E Bredefeld
*Assistant Examiner* — Erinne R Dabkowski
(74) *Attorney, Agent, or Firm* — Cantor Colburn LLP

(57) ABSTRACT

The present disclosure relates to a class of engineered polypeptides having a binding affinity for albumin. In particular, the present invention relates to albumin binding polypeptides which have a high resistance to proteolytic cleavage and therapeutic use thereof. The disclosure provides an albumin binding polypeptide comprising an albumin binding motif, which motif consists of the amino acid sequence (SEQ ID NO. 1782)
$GX_4SDX_5YKX_8X_9I\ X_{11}X_{12}AX_{14}TVEGVX_{20}\ ALX_{23}X_{24}X_{25}ILX_{28}X_{29}X_B$.

19 Claims, 76 Drawing Sheets

Specification includes a Sequence Listing.

(56) References Cited

OTHER PUBLICATIONS

Langer, M. et al., "Novel Peptide Conjugates for Tumor-Specific Chemotherapy", J. Med. Chem. 2001, 44, pp. 1341-1348.
Parker, Andrew S. et al., "Optimization algorithms for functional deimmunization of therapeutic proteins", BMC Bioinformatics 2010, 11:180; pp. 1-15.
Qui, Y. et al., "Oestrogen-induced apoptosis in colonocytes expressing oestrogen receptor B", Journal of Endocrinology (2002) 174, pp. 369-377.
Yamamoto, Akira "Improvement of Transmucosal Absorption of Biologically Active Peptide Drugs", published by Yakugaku, Zasshi (Journal of the Pharmaceutical Society of Japan), 2001, vol. 121, No. 12, p. 929-948 (English abstract only).
International Search Report for International Application No. PCT/EP2014/078756; International Application Filing Date: Dec. 19, 2014; dated Mar. 26, 2015; 2 pages.
De Chateau, M., "Protein PAB, a Mosaic Albumin-binding Bacterial Protein Representing the First Contemporary Example of Modulue Shuffling", The Journal of Biological Chemistry, Apr. 22, 1994; vol. 269 (16) pp. 12147-12151.
Goetsch et al. "Identification of B- and T-Cell Epitopes of BB, a Carrier Protein Derived from the G Protein of *Streptococcus* Strain G148" Clinical and Diagnostic Laboratory Immunology; vol. 10, No. 1; Jan. 2003, pp. 125-132.
He et al., "An Artificaily Evolved Albumin Binding Module Facilitates Chemical Shift Epitope Maping of GA Domain Interactions with Phylogenetically Diverse Albumins" The Protein Society, vol. 16, (2007) pp. 1490-1494.
IPRP and Written Opinion of the International Searching Authority for International Patent Application No. PCT/EP2014/078756; International Filing Date: Dec. 19, 2014; dated Jun. 21, 2016; 8 Pages.
Jonsson; "Engineering of a femtomolar affinity binding protein to human serum albumin"; Protein Engineering, Design & Selection, vol. 21, No. 8; 2008; pp. 515-527.
Labouesse "The Hydrolysis of Glucagon by Clostripain" Bulletin de la Societe de Chimie Biologique; 42(11); (1960); pp. 1293-1304. With English Abstract.
Labrou et al., "The Structure-Function Relationship in the Clostripain Family of Peptidases", Eur. J. Biochem. 271; (2004); pp. 983-992.
Mitchell et al., "Purification and Properties of Clostridiopeptidase B (Clostripain)", The Journal of Biological Chemistry; vol. 243; No. 18; (1968); pp. 4683-4692.
Sletten et al.; "Bioorthogonal Chemistry: Fishing for Selectivity in a Sea of Functionality"; Angew Chem Int Ed Engl., 48(38); 2009; 6974-6998.
Sosabowski et al.; "Conjugation of DOTA-like chelating agents to peptides and radiolabeling with trivalent metallic isotopes"; Nature Protocols, vol. 1,No, 2; 2006; 972-976.
Tanaka et al., "High-level Production and Purification of Clostripain Expressed in a Virulence-Attenuated Strain of Clostridium Perfringens", Protein Expression and Purification; 76 (2011); pp. 83-89.
Tanaka et al.; "M-Terminal glycine-specific protein conjugation catalyzed by microbial transglutaminase"; FEBS Letters; 579; 2005; 2092-2096.
The online Medical Dictionary; "Definition of Derivative"; accessed on Jul. 7, 2005; 3 pages.
Yanan et al.; "An Artificially Evolved Albumin Binding Module Facilitates Chemical Shift Epitope Mapping of GA Domain Interactions with Phylogenetically Diverse Albumins", Protein Science; 16; (2007); pp. 1490-1494.
Frye, C.A., et al., "P-3-BSA, but not P-11-PSA, implants in the VTA rapidly facilitate receptivity in hamsters after progesterone priming to the VMH", Behavioural Brain Research, 53 (1993) pp. 167-175.
Strohl, William R., "Fusion Proteins for Half-Life Extension of Biologics as a Strategy to Make Biobetters", BioDrugs (2015) 29 pp. 215-239.
Peppas et al., Hydrogels for oral delivery of therapeutic proteins, Expert Opin. Biol. Ther., 2004, 4(6), pp. 1-7.

Figure 1A

| Designation | Amino acid sequence | SEQ ID NO |
|---|---|---|
| PEP18049 | LAEAKEAANAELDSY-GCSDFYKRLIDKAKTVEGVEALKDAILAAKP | SEQ ID NO: 1 |
| 001_KC | LAEAKEAANAELDSY-GKSDFYKRLIDKAKTVEGVEALKDAILAAC-P | SEQ ID NO: 2 |
| PEP14788 | LAEAKEAANAELDSY-GCSDFYKRLIDKAKTVEGVEALKDAILAAC-P | SEQ ID NO: 3 |
| 001_KK | LAEAKEAANAELDSY-GKSDFYKRLIDKAKTVEGVEALKDAILAAK-P | SEQ ID NO: 4 |
| 002_CK | LAEAKVLANRELDKY-GCSDFYKNLINRAKTVEGVHALIGHILAAK-P | SEQ ID NO: 5 |
| 002_KC | LAEAKVLANRELDKY-GKSDFYKNLINRAKTVEGVHALIGHILAAC-P | SEQ ID NO: 6 |
| 002_CC | LAEAKVLANRELDKY-GCSDFYKNLINRAKTVEGVHALIGHILAAC-P | SEQ ID NO: 7 |
| 002_KK | LAEAKVLANRELDKY-GKSDFYKNLINRAKTVEGVHALIGHILAAK-P | SEQ ID NO: 8 |
| 003_CK | LAEAKVLANRELDKY-GCSDFYKNVINRAKTVEGVHALIDHILAAK-P | SEQ ID NO: 9 |
| 003_KC | LAEAKVLANRELDKY-GKSDFYKNVINRAKTVEGVHALIDHILAAC-P | SEQ ID NO: 10 |
| 003_CC | LAEAKVLANRELDKY-GCSDFYKNVINRAKTVEGVHALIDHILAAC-P | SEQ ID NO: 11 |
| 003_KK | LAEAKVLANRELDKY-GKSDFYKNVINRAKTVEGVHALIDHILAAK-P | SEQ ID NO: 12 |
| 004_CK | LAEAKVLANRELDKY-GCSDYYKNIINRAKTVEGVRALKLHILAAK-P | SEQ ID NO: 13 |
| 004_KC | LAEAKVLANRELDKY-GKSDYYKNIINRAKTVEGVRALKLHILAAC-P | SEQ ID NO: 14 |
| 004_CC | LAEAKVLANRELDKY-GCSDYYKNIINRAKTVEGVRALKLHILAAC-P | SEQ ID NO: 15 |
| 004_KK | LAEAKVLANRELDKY-GKSDYYKNIINRAKTVEGVRALKLHILAAK-P | SEQ ID NO: 16 |
| 005_CK | LAEAKVLANRELDKY-GCSDFYKNVINRAKTVEGVSALIHEILAAK-P | SEQ ID NO: 17 |
| 005_KC | LAEAKVLANRELDKY-GKSDFYKNVINRAKTVEGVSALIHEILAAC-P | SEQ ID NO: 18 |
| 005_CC | LAEAKVLANRELDKY-GCSDFYKNVINRAKTVEGVSALIHEILAAC-P | SEQ ID NO: 19 |
| 005_KK | LAEAKVLANRELDKY-GKSDFYKNVINRAKTVEGVSALIHEILAAK-P | SEQ ID NO: 20 |
| 006_CK | LAEAKVLANRELDKY-GCSDFYKRLINRAKTVEGVNTLIADILAAK-P | SEQ ID NO: 21 |
| 006_KC | LAEAKVLANRELDKY-GKSDFYKRLINRAKTVEGVNTLIADILAAC-P | SEQ ID NO: 22 |
| 006_CC | LAEAKVLANRELDKY-GCSDFYKRLINRAKTVEGVNTLIADILAAC-P | SEQ ID NO: 23 |
| 006_KK | LAEAKVLANRELDKY-GKSDFYKRLINRAKTVEGVNTLIADILAAK-P | SEQ ID NO: 24 |
| 007_CK | LAEAKVLANRELDKY-GCSDFYKNLINRAKTVEGVNTLIADILAAK-P | SEQ ID NO: 25 |
| 007_KC | LAEAKVLANRELDKY-GKSDFYKNLINRAKTVEGVNTLIADILAAC-P | SEQ ID NO: 26 |

Figure 1B

| Designation | Amino acid sequence | SEQ ID NO |
|---|---|---|
| 007_CC | LAEAKVLANRELDKY-GCSDFYKNLINRAKTVEGVNTLIADILAAC-P | SEQ ID NO: 27 |
| 007_KK | LAEAKVLANRELDKY-GKSDFYKNLINRAKTVEGVNTLIADILAAK-P | SEQ ID NO: 28 |
| 008_CK | LAEAKVLANRELDKY-GCSDYYKNLINRAKTVEGVNSLISHILAAK-P | SEQ ID NO: 29 |
| 008_KC | LAEAKVLANRELDKY-GKSDYYKNLINRAKTVEGVNSLISHILAAC-P | SEQ ID NO: 30 |
| 008_CC | LAEAKVLANRELDKY-GCSDYYKNLINRAKTVEGVNSLISHILAAC-P | SEQ ID NO: 31 |
| 008_KK | LAEAKVLANRELDKY-GKSDYYKNLINRAKTVEGVNSLISHILAAK-P | SEQ ID NO: 32 |
| 009_CK | LAEAKVLANRELDKY-GCSDFYKRLINRAKTVGGVQSLISEILAAK-P | SEQ ID NO: 33 |
| 009_KC | LAEAKVLANRELDKY-GKSDFYKRLINRAKTVGGVQSLISEILAAC-P | SEQ ID NO: 34 |
| 009_CC | LAEAKVLANRELDKY-GCSDFYKRLINRAKTVGGVQSLISEILAAC-P | SEQ ID NO: 35 |
| 09_KK | LAEAKVLANRELDKY-GKSDFYKRLINRAKTVGGVQSLISEILAAK-P | SEQ ID NO: 36 |
| 010_CK | LAEAKVLANRELDKY-GCSDFYKNLINRAKTVEGVSSLKGHILAAK-P | SEQ ID NO: 37 |
| 010_KC | LAEAKVLANRELDKY-GKSDFYKNLINRAKTVEGVSSLKGHILAAC-P | SEQ ID NO: 38 |
| 010_CC | LAEAKVLANRELDKY-GCSDFYKNLINRAKTVEGVSSLKGHILAAC-P | SEQ ID NO: 39 |
| 010_KK | LAEAKVLANRELDKY-GKSDFYKNLINRAKTVEGVSSLKGHILAAK-P | SEQ ID NO: 40 |
| 011_CK | LAEAKVLANRELDKY-GCSDFYKNVINRAKTVEGVDSLIAEILAAK-P | SEQ ID NO: 41 |
| 011_KC | LAEAKVLANRELDKY-GKSDFYKNVINRAKTVEGVDSLIAEILAAC-P | SEQ ID NO: 42 |
| 011_CC | LAEAKVLANRELDKY-GCSDFYKNVINRAKTVEGVDSLIAEILAAC-P | SEQ ID NO: 43 |
| 011_KK | LAEAKVLANRELDKY-GKSDFYKNVINRAKTVEGVDSLIAEILAAK-P | SEQ ID NO: 44 |
| 012_CK | LAEAKVLANRELDKY-GCSDFYKNLINRARTVEGVQTLISDILAAK-P | SEQ ID NO: 45 |
| 012_KC | LAEAKVLANRELDKY-GKSDFYKNLINRARTVEGVQTLISDILAAC-P | SEQ ID NO: 46 |
| 012_CC | LAEAKVLANRELDKY-GCSDFYKNLINRARTVEGVQTLISDILAAC-P | SEQ ID NO: 47 |
| 012_KK | LAEAKVLANRELDKY-GKSDFYKNLINRARTVEGVQTLISDILAAK-P | SEQ ID NO: 48 |
| 013_CK | LAEAKVLANRELDKY-GCSDFYKKFINKAKTVEGVETLISEILAAK-P | SEQ ID NO: 49 |
| 013_KC | LAEAKVLANRELDKY-GKSDFYKKFINKAKTVEGVETLISEILAAC-P | SEQ ID NO: 50 |
| 013_CC | LAEAKVLANRELDKY-GCSDFYKKFINKAKTVEGVETLISEILAAC-P | SEQ ID NO: 51 |
| 013_KK | LAEAKVLANRELDKY-GKSDFYKKFINKAKTVEGVETLISEILAAK-P | SEQ ID NO: 52 |

Figure 1C

| Designation | Amino acid sequence | SEQ ID NO |
|---|---|---|
| 014_CK | LAEAKVLANRELDKY-GCSDFYKSLINRAKTVEGVHSLTDEILAAK-P | SEQ ID NO: 53 |
| 014_KC | LAEAKVLANRELDKY-GKSDFYKSLINRAKTVEGVHSLTDEILAAC-P | SEQ ID NO: 54 |
| 014_CC | LAEAKVLANRELDKY-GCSDFYKSLINRAKTVEGVHSLTDEILAAC-P | SEQ ID NO: 55 |
| 014_KK | LAEAKVLANRELDKY-GKSDFYKSLINRAKTVEGVHSLTDEILAAK-P | SEQ ID NO: 56 |
| 015_CK | LAEAKVLANRELDKY-GCSDYYKNVINKAKTVEGVSSLTAEILAAK-P | SEQ ID NO: 57 |
| 015_KC | LAEAKVLANRELDKY-GKSDYYKNVINKAKTVEGVSSLTAEILAAC-P | SEQ ID NO: 58 |
| 015_CC | LAEAKVLANRELDKY-GCSDYYKNVINKAKTVEGVSSLTAEILAAC-P | SEQ ID NO: 59 |
| 015_KK | LAEAKVLANRELDKY-GKSDYYKNVINKAKTVEGVSSLTAEILAAK-P | SEQ ID NO: 60 |
| 016_CK | LAEAKVLANRELDKY-GCSDFYKSLINRAKTVEGVDALTSHILAAK-P | SEQ ID NO: 61 |
| 016_KC | LAEAKVLANRELDKY-GKSDFYKSLINRAKTVEGVDALTSHILAAC-P | SEQ ID NO: 62 |
| 016_CC | LAEAKVLANRELDKY-GCSDFYKSLINRAKTVEGVDALTSHILAAC-P | SEQ ID NO: 63 |
| 016_KK | LAEAKVLANRELDKY-GKSDFYKSLINRAKTVEGVDALTSHILAAK-P | SEQ ID NO: 64 |
| 017_CK | LAEAKVLANRELDKY-GCSDFYKNLINKAKTVEGVSTLIHDILAAK-P | SEQ ID NO: 65 |
| 017_KC | LAEAKVLANRELDKY-GKSDFYKNLINKAKTVEGVSTLIHDILAAC-P | SEQ ID NO: 66 |
| 017_CC | LAEAKVLANRELDKY-GCSDFYKNLINKAKTVEGVSTLIHDILAAC-P | SEQ ID NO: 67 |
| 017_KK | LAEAKVLANRELDKY-GKSDFYKNLINKAKTVEGVSTLIHDILAAK-P | SEQ ID NO: 68 |
| 018_CK | LAEAKVLANRELDKY-GCSDFYKNLINRAKTVEGVSTLIHDILAAK-P | SEQ ID NO: 69 |
| 018_KC | LAEAKVLANRELDKY-GKSDFYKNLINRAKTVEGVSTLIHDILAAC-P | SEQ ID NO: 70 |
| 018_CC | LAEAKVLANRELDKY-GCSDFYKNLINRAKTVEGVSTLIHDILAAC-P | SEQ ID NO: 71 |
| 018_KK | LAEAKVLANRELDKY-GKSDFYKNLINRAKTVEGVSTLIHDILAAK-P | SEQ ID NO: 72 |
| 019_CK | LAEAKVLANRELDKY-GCSDFYKNLINRAKTVEGVQALISEILAAK-P | SEQ ID NO: 73 |
| 019_KC | LAEAKVLANRELDKY-GKSDFYKNLINRAKTVEGVQALISEILAAC-P | SEQ ID NO: 74 |
| 019_CC | LAEAKVLANRELDKY-GCSDFYKNLINRAKTVEGVQALISEILAAC-P | SEQ ID NO: 75 |
| 019_KK | LAEAKVLANRELDKY-GKSDFYKNLINRAKTVEGVQALISEILAAK-P | SEQ ID NO: 76 |
| 020_CK | LAEAKVLANRELDKY-GCSDYYKSLINKAKTVEGVDSLIVHILAAK-P | SEQ ID NO: 77 |
| 020_KC | LAEAKVLANRELDKY-GKSDYYKSLINKAKTVEGVDSLIVHILAAC-P | SEQ ID NO: 78 |

Figure 1D

| Designation | Amino acid sequence | SEQ ID NO |
|---|---|---|
| 020_CC | LAEAKVLANRELDKY-GCSDYYKSLINKAKTVEGVDSLIVHILAAC-P | SEQ ID NO: 79 |
| 020_KK | LAEAKVLANRELDKY-GKSDYYKSLINKAKTVEGVDSLIVHILAAK-P | SEQ ID NO: 80 |
| 021_CK | LAEAKVLANRELDKY-GCSDFYKNLINRAKTVEGVQSLITEILAAK-P | SEQ ID NO: 81 |
| 021_KC | LAEAKVLANRELDKY-GKSDFYKNLINRAKTVEGVQSLITEILAAC-P | SEQ ID NO: 82 |
| 021_CC | LAEAKVLANRELDKY-GCSDFYKNLINRAKTVEGVQSLITEILAAC-P | SEQ ID NO: 83 |
| 021_KK | LAEAKVLANRELDKY-GKSDFYKNLINRAKTVEGVQSLITEILAAK-P | SEQ ID NO: 84 |
| 022_CK | LAEAKVLANRELDKY-GCSDYYKNLINRAKTVEGVDALITHILAAK-P | SEQ ID NO: 85 |
| 022_KC | LAEAKVLANRELDKY-GKSDYYKNLINRAKTVEGVDALITHILAAC-P | SEQ ID NO: 86 |
| 022_CC | LAEAKVLANRELDKY-GCSDYYKNLINRAKTVEGVDALITHILAAC-P | SEQ ID NO: 87 |
| 022_KK | LAEAKVLANRELDKY-GKSDYYKNLINRAKTVEGVDALITHILAAK-P | SEQ ID NO: 88 |
| 023_CK | LAEAKVLANRELDKY-GCSDFYKSMINRAKTVEGVDSLITHILAAK-P | SEQ ID NO: 89 |
| 023_KC | LAEAKVLANRELDKY-GKSDFYKSMINRAKTVEGVDSLITHILAAC-P | SEQ ID NO: 90 |
| 023_CC | LAEAKVLANRELDKY-GCSDFYKSMINRAKTVEGVDSLITHILAAC-P | SEQ ID NO: 91 |
| 023_KK | LAEAKVLANRELDKY-GKSDFYKSMINRAKTVEGVDSLITHILAAK-P | SEQ ID NO: 92 |
| 024_CK | LAEAKVLANRELDKY-GCSDFYKNLINRAKTVEGVTTLTTDILAAK-P | SEQ ID NO: 93 |
| 024_KC | LAEAKVLANRELDKY-GKSDFYKNLINRAKTVEGVTTLTTDILAAC-P | SEQ ID NO: 94 |
| 024_CC | LAEAKVLANRELDKY-GCSDFYKNLINRAKTVEGVTTLTTDILAAC-P | SEQ ID NO: 95 |
| 024_KK | LAEAKVLANRELDKY-GKSDFYKNLINRAKTVEGVTTLTTDILAAK-P | SEQ ID NO: 96 |
| 025_CK | LAEAKVLANRELDKY-GCSDFYKNLINRAKTVEGVESLIDHILAAK-P | SEQ ID NO: 97 |
| 025_KC | LAEAKVLANRELDKY-GKSDFYKNLINRAKTVEGVESLIDHILAAC-P | SEQ ID NO: 98 |
| 025_CC | LAEAKVLANRELDKY-GCSDFYKNLINRAKTVEGVESLIDHILAAC-P | SEQ ID NO: 99 |
| 025_KK | LAEAKVLANRELDKY-GKSDFYKNLINRAKTVEGVESLIDHILAAK-P | SEQ ID NO: 100 |
| 026_CK | LAEAKVLANRELDKY-GCSDFYKSYINRAKTVEGVHTLIGHILAAK-P | SEQ ID NO: 101 |
| 026_KC | LAEAKVLANRELDKY-GKSDFYKSYINRAKTVEGVHTLIGHILAAC-P | SEQ ID NO: 102 |
| 026_CC | LAEAKVLANRELDKY-GCSDFYKSYINRAKTVEGVHTLIGHILAAC-P | SEQ ID NO: 103 |
| 026_KK | LAEAKVLANRELDKY-GKSDFYKSYINRAKTVEGVHTLIGHILAAK-P | SEQ ID NO: 104 |

Figure 1E

| Designation | Amino acid sequence | SEQ ID NO |
|---|---|---|
| 027_CK | LAEAKVLANRELDKY-GCSDFYKNLINRAKTVEGVQTLISDILAAK-P | SEQ ID NO: 105 |
| 027_KC | LAEAKVLANRELDKY-GKSDFYKNLINRAKTVEGVQTLISDILAAC-P | SEQ ID NO: 106 |
| 027_CC | LAEAKVLANRELDKY-GCSDFYKNLINRAKTVEGVQTLISDILAAC-P | SEQ ID NO: 107 |
| 027_KK | LAEAKVLANRELDKY-GKSDFYKNLINRAKTVEGVQTLISDILAAK-P | SEQ ID NO: 108 |
| 028_CK | LAEAKVLANRELDKY-GCSDFYKNLINRAKTVEGVNSLTSHILAAK-P | SEQ ID NO: 109 |
| 028_KC | LAEAKVLANRELDKY-GKSDFYKNLINRAKTVEGVNSLTSHILAAC-P | SEQ ID NO: 110 |
| 028_CC | LAEAKVLANRELDKY-GCSDFYKNLINRAKTVEGVNSLTSHILAAC-P | SEQ ID NO: 111 |
| 028_KK | LAEAKVLANRELDKY-GKSDFYKNLINRAKTVEGVNSLTSHILAAK-P | SEQ ID NO: 112 |
| 029_CK | LAEAKVLANRELDKY-GCSDFYKNLINRAKTVEGVNTLIHDILAAK-P | SEQ ID NO: 113 |
| 029_KC | LAEAKVLANRELDKY-GKSDFYKNLINRAKTVEGVNTLIHDILAAC-P | SEQ ID NO: 114 |
| 029_CC | LAEAKVLANRELDKY-GCSDFYKNLINRAKTVEGVNTLIHDILAAC-P | SEQ ID NO: 115 |
| 029_KK | LAEAKVLANRELDKY-GKSDFYKNLINRAKTVEGVNTLIHDILAAK-P | SEQ ID NO: 116 |
| 030_CK | LAEAKVLANRELDKY-GCSDFYKNLINRAKTVEGVESLIGEILAAK-P | SEQ ID NO: 117 |
| 030_KC | LAEAKVLANRELDKY-GKSDFYKNLINRAKTVEGVESLIGEILAAC-P | SEQ ID NO: 118 |
| 030_CC | LAEAKVLANRELDKY-GCSDFYKNLINRAKTVEGVESLIGEILAAC-P | SEQ ID NO: 119 |
| 030_KK | LAEAKVLANRELDKY-GKSDFYKNLINRAKTVEGVESLIGEILAAK-P | SEQ ID NO: 120 |
| 031_CK | LAEAKVLANRELDKY-GCSDFYKNLINKAKTVEGVHTLIHDILAAK-P | SEQ ID NO: 121 |
| 031_KC | LAEAKVLANRELDKY-GKSDFYKNLINKAKTVEGVHTLIHDILAAC-P | SEQ ID NO: 122 |
| 031_CC | LAEAKVLANRELDKY-GCSDFYKNLINKAKTVEGVHTLIHDILAAC-P | SEQ ID NO: 123 |
| 031_KK | LAEAKVLANRELDKY-GKSDFYKNLINKAKTVEGVHTLIHDILAAK-P | SEQ ID NO: 124 |
| 032_CK | LAEAKVLANRELDKY-GCSDYYKNLINKAKTVEGVSALKMHILAAK-P | SEQ ID NO: 125 |
| 032_KC | LAEAKVLANRELDKY-GKSDYYKNLINKAKTVEGVSALKMHILAAC-P | SEQ ID NO: 126 |
| 032_CC | LAEAKVLANRELDKY-GCSDYYKNLINKAKTVEGVSALKMHILAAC-P | SEQ ID NO: 127 |
| 032_KK | LAEAKVLANRELDKY-GKSDYYKNLINKAKTVEGVSALKMHILAAK-P | SEQ ID NO: 128 |
| 033_CK | LAEAKVLANRELDKY-GCSDFYKNLINKAKTVEGVDALIVHILAAK-P | SEQ ID NO: 129 |
| 033_KC | LAEAKVLANRELDKY-GKSDFYKNLINKAKTVEGVDALIVHILAAC-P | SEQ ID NO: 130 |

Figure 1F

| Designation | Amino acid sequence | SEQ ID NO |
|---|---|---|
| 033_CC | LAEAKVLANRELDKY-GCSDFYKNLINKAKTVEGVDALIVHILAAC-P | SEQ ID NO: 131 |
| 033_KK | LAEAKVLANRELDKY-GKSDFYKNLINKAKTVEGVDALIVHILAAK-P | SEQ ID NO: 132 |
| 034_CK | LAEAKVLANRELDKY-GCSDYYKRLINRAKTVEGVHALIAEILAAK-P | SEQ ID NO: 133 |
| 034_KC | LAEAKVLANRELDKY-GKSDYYKRLINRAKTVEGVHALIAEILAAC-P | SEQ ID NO: 134 |
| 034_CC | LAEAKVLANRELDKY-GCSDYYKRLINRAKTVEGVHALIAEILAAC-P | SEQ ID NO: 135 |
| 034_KK | LAEAKVLANRELDKY-GKSDYYKRLINRAKTVEGVHALIAEILAAK-P | SEQ ID NO: 136 |
| 035_CK | LAEAKVLANRELDKY-GCSDYYKNLINRARTVEGVDTLIHDILAAK-P | SEQ ID NO: 137 |
| 035_KC | LAEAKVLANRELDKY-GKSDYYKNLINRARTVEGVDTLIHDILAAC-P | SEQ ID NO: 138 |
| 035_CC | LAEAKVLANRELDKY-GCSDYYKNLINRARTVEGVDTLIHDILAAC-P | SEQ ID NO: 139 |
| 035_KK | LAEAKVLANRELDKY-GKSDYYKNLINRARTVEGVDTLIHDILAAK-P | SEQ ID NO: 140 |
| 036_CK | LAEAKVLANRELDKY-GCSDFYKKVINRARTVEGVQALIADILAAK-P | SEQ ID NO: 141 |
| 036_KC | LAEAKVLANRELDKY-GKSDFYKKVINRARTVEGVQALIADILAAC-P | SEQ ID NO: 142 |
| 036_CC | LAEAKVLANRELDKY-GCSDFYKKVINRARTVEGVQALIADILAAC-P | SEQ ID NO: 143 |
| 036_KK | LAEAKVLANRELDKY-GKSDFYKKVINRARTVEGVQALIADILAAK-P | SEQ ID NO: 144 |
| 037_CK | LAEAKVLANRELDKY-GCSDFYKNLINRAKTVEGVESLIADILAAK-P | SEQ ID NO: 145 |
| 037_KC | LAEAKVLANRELDKY-GKSDFYKNLINRAKTVEGVESLIADILAAC-P | SEQ ID NO: 146 |
| 037_CC | LAEAKVLANRELDKY-GCSDFYKNLINRAKTVEGVESLIADILAAC-P | SEQ ID NO: 147 |
| 037_KK | LAEAKVLANRELDKY-GKSDFYKNLINRAKTVEGVESLIADILAAK-P | SEQ ID NO: 148 |
| 038_CK | LAEAKVLANRELDKY-GCSDYYKNLINKAKTVEGVDALIAHILAAK-P | SEQ ID NO: 149 |
| 038_KC | LAEAKVLANRELDKY-GKSDYYKNLINKAKTVEGVDALIAHILAAC-P | SEQ ID NO: 150 |
| 038_CC | LAEAKVLANRELDKY-GCSDYYKNLINKAKTVEGVDALIAHILAAC-P | SEQ ID NO: 151 |
| 038_KK | LAEAKVLANRELDKY-GKSDYYKNLINKAKTVEGVDALIAHILAAK-P | SEQ ID NO: 152 |
| 039_CK | LAEAKVLANRELDKY-GCSDYYKNLINRAKTVEGVESLITHILAAK-P | SEQ ID NO: 153 |
| 039_KC | LAEAKVLANRELDKY-GKSDYYKNLINRAKTVEGVESLITHILAAC-P | SEQ ID NO: 154 |
| 039_CC | LAEAKVLANRELDKY-GCSDYYKNLINRAKTVEGVESLITHILAAC-P | SEQ ID NO: 155 |
| 039_KK | LAEAKVLANRELDKY-GKSDYYKNLINRAKTVEGVESLITHILAAK-P | SEQ ID NO: 156 |

Figure 1G

| Designation | Amino acid sequence | SEQ ID NO |
|---|---|---|
| 040_CK | LAEAKVLANRELDKY-GCSDFYKNLINRARTVEGVDSLIVEILAAK-P | SEQ ID NO: 157 |
| 040_KC | LAEAKVLANRELDKY-GKSDFYKNLINRARTVEGVDSLIVEILAAC-P | SEQ ID NO: 158 |
| 040_CC | LAEAKVLANRELDKY-GCSDFYKNLINRARTVEGVDSLIVEILAAC-P | SEQ ID NO: 159 |
| 040_KK | LAEAKVLANRELDKY-GKSDFYKNLINRARTVEGVDSLIVEILAAK-P | SEQ ID NO: 160 |
| 041_CK | LAEAKVLANRELDKY-GCSDFYKNVINRAKTVEGVSALIREILAAK-P | SEQ ID NO: 161 |
| 041_KC | LAEAKVLANRELDKY-GKSDFYKNVINRAKTVEGVSALIREILAAC-P | SEQ ID NO: 162 |
| 041_CC | LAEAKVLANRELDKY-GCSDFYKNVINRAKTVEGVSALIREILAAC-P | SEQ ID NO: 163 |
| 041_KK | LAEAKVLANRELDKY-GKSDFYKNVINRAKTVEGVSALIREILAAK-P | SEQ ID NO: 164 |
| 042_CK | LAEAKVLANRELDKY-GCSDFYKNLINRAKTVEGVNALISDILAAK-P | SEQ ID NO: 165 |
| 042_KC | LAEAKVLANRELDKY-GKSDFYKNLINRAKTVEGVNALISDILAAC-P | SEQ ID NO: 166 |
| 042_CC | LAEAKVLANRELDKY-GCSDFYKNLINRAKTVEGVNALISDILAAC-P | SEQ ID NO: 167 |
| 042_KK | LAEAKVLANRELDKY-GKSDFYKNLINRAKTVEGVNALISDILAAK-P | SEQ ID NO: 168 |
| 043_CK | LAEAKVLANRELDKY-GCSDFYKNLINRAKTVEGVSALIQEILAAK-P | SEQ ID NO: 169 |
| 043_KC | LAEAKVLANRELDKY-GKSDFYKNLINRAKTVEGVSALIQEILAAC-P | SEQ ID NO: 170 |
| 043_CC | LAEAKVLANRELDKY-GCSDFYKNLINRAKTVEGVSALIQEILAAC-P | SEQ ID NO: 171 |
| 043_KK | LAEAKVLANRELDKY-GKSDFYKNLINRAKTVEGVSALIQEILAAK-P | SEQ ID NO: 172 |
| 044_CK | LAEAKVLANRELDKY-GCSDFYKNLINRAKTVEGVQSLIDHILAAK-P | SEQ ID NO: 173 |
| 044_KC | LAEAKVLANRELDKY-GKSDFYKNLINRAKTVEGVQSLIDHILAAC-P | SEQ ID NO: 174 |
| 044_CC | LAEAKVLANRELDKY-GCSDFYKNLINRAKTVEGVQSLIDHILAAC-P | SEQ ID NO: 175 |
| 044_KK | LAEAKVLANRELDKY-GKSDFYKNLINRAKTVEGVQSLIDHILAAK-P | SEQ ID NO: 176 |
| 045_CK | LAEAKVLANRELDKY-GCSDFYKNLINRAKTVEGVDALICHILAAK-P | SEQ ID NO: 177 |
| 045_KC | LAEAKVLANRELDKY-GKSDFYKNLINRAKTVEGVDALICHILAAC-P | SEQ ID NO: 178 |
| 045_CC | LAEAKVLANRELDKY-GCSDFYKNLINRAKTVEGVDALICHILAAC-P | SEQ ID NO: 179 |
| 045_KK | LAEAKVLANRELDKY-GKSDFYKNLINRAKTVEGVDALICHILAAK-P | SEQ ID NO: 180 |
| 046_CK | LAEAKVLANRELDKY-GCSDYYKRLINKAKTVEGVNALITHILAAK-P | SEQ ID NO: 181 |
| 046_KC | LAEAKVLANRELDKY-GKSDYYKRLINKAKTVEGVNALITHILAAC-P | SEQ ID NO: 182 |

Figure 1H

| Designation | Amino acid sequence | SEQ ID NO |
|---|---|---|
| 046_CC | LAEAKVLANRELDKY-GCSDYYKRLINKAKTVEGVNALITHILAAC-P | SEQ ID NO: 183 |
| 046_KK | LAEAKVLANRELDKY-GKSDYYKRLINKAKTVEGVNALITHILAAK-P | SEQ ID NO: 184 |
| 047_CK | LAEAKVLANRELDKY-GCSDFYKNVINKAKTVEGVEALIADILAAK-P | SEQ ID NO: 185 |
| 047_KC | LAEAKVLANRELDKY-GKSDFYKNVINKAKTVEGVEALIADILAAC-P | SEQ ID NO: 186 |
| 047_CC | LAEAKVLANRELDKY-GCSDFYKNVINKAKTVEGVEALIADILAAC-P | SEQ ID NO: 187 |
| 047_KK | LAEAKVLANRELDKY-GKSDFYKNVINKAKTVEGVEALIADILAAK-P | SEQ ID NO: 188 |
| 048_CK | LAEAKVLANRELDKY-GCSDFYKNLINRAKTVEGVETLIRDILAAK-P | SEQ ID NO: 189 |
| 048_KC | LAEAKVLANRELDKY-GKSDFYKNLINRAKTVEGVETLIRDILAAC-P | SEQ ID NO: 190 |
| 048_CC | LAEAKVLANRELDKY-GCSDFYKNLINRAKTVEGVETLIRDILAAC-P | SEQ ID NO: 191 |
| 048_KK | LAEAKVLANRELDKY-GKSDFYKNLINRAKTVEGVETLIRDILAAK-P | SEQ ID NO: 192 |
| 049_CK | LAEAKVLANRELDKY-GCSDFYKNLINRARTVEGVQTLITDILAAK-P | SEQ ID NO: 193 |
| 049_KC | LAEAKVLANRELDKY-GKSDFYKNLINRARTVEGVQTLITDILAAC-P | SEQ ID NO: 194 |
| 049_CC | LAEAKVLANRELDKY-GCSDFYKNLINRARTVEGVQTLITDILAAC-P | SEQ ID NO: 195 |
| 049_KK | LAEAKVLANRELDKY-GKSDFYKNLINRARTVEGVQTLITDILAAK-P | SEQ ID NO: 196 |
| 050_CK | LAEAKVLANRELDKY-GCSDFYKRLINKAKTVEGVNALTHHILAAK-P | SEQ ID NO: 197 |
| 050_KC | LAEAKVLANRELDKY-GKSDFYKRLINKAKTVEGVNALTHHILAAC-P | SEQ ID NO: 198 |
| 050_CC | LAEAKVLANRELDKY-GCSDFYKRLINKAKTVEGVNALTHHILAAC-P | SEQ ID NO: 199 |
| 050_KK | LAEAKVLANRELDKY-GKSDFYKRLINKAKTVEGVNALTHHILAAK-P | SEQ ID NO: 200 |
| 051_CK | LAEAKVLANRELDKY-GCSDYYKNLINRAKTVEGVQALIAHILAAK-P | SEQ ID NO: 201 |
| 051_KC | LAEAKVLANRELDKY-GKSDYYKNLINRAKTVEGVQALIAHILAAC-P | SEQ ID NO: 202 |
| 051_CC | LAEAKVLANRELDKY-GCSDYYKNLINRAKTVEGVQALIAHILAAC-P | SEQ ID NO: 203 |
| 051_KK | LAEAKVLANRELDKY-GKSDYYKNLINRAKTVEGVQALIAHILAAK-P | SEQ ID NO: 204 |
| 052_CK | LAEAKVLANRELDKY-GCSDFYKNVINRAKTVEGVNSLINHILAAK-P | SEQ ID NO: 205 |
| 052_KC | LAEAKVLANRELDKY-GKSDFYKNVINRAKTVEGVNSLINHILAAC-P | SEQ ID NO: 206 |
| 052_CC | LAEAKVLANRELDKY-GCSDFYKNVINRAKTVEGVNSLINHILAAC-P | SEQ ID NO: 207 |
| 052_KK | LAEAKVLANRELDKY-GKSDFYKNVINRAKTVEGVNSLINHILAAK-P | SEQ ID NO: 208 |

Figure 1I

| Designation | Amino acid sequence | SEQ ID NO |
|---|---|---|
| 053_CK | LAEAKVLANRELDKY-GCSDFYKSLINRARTVEGVDSLIRHILAAK-P | SEQ ID NO: 209 |
| 053_KC | LAEAKVLANRELDKY-GKSDFYKSLINRARTVEGVDSLIRHILAAC-P | SEQ ID NO: 210 |
| 053_CC | LAEAKVLANRELDKY-GCSDFYKSLINRARTVEGVDSLIRHILAAC-P | SEQ ID NO: 211 |
| 053_KK | LAEAKVLANRELDKY-GKSDFYKSLINRARTVEGVDSLIRHILAAK-P | SEQ ID NO: 212 |
| 054_CK | LAEAKVLANRELDKY-GCSDYYKNLINKAKTVEGVEALTLHILAAK-P | SEQ ID NO: 213 |
| 054_KC | LAEAKVLANRELDKY-GKSDYYKNLINKAKTVEGVEALTLHILAAC-P | SEQ ID NO: 214 |
| 054_CC | LAEAKVLANRELDKY-GCSDYYKNLINKAKTVEGVEALTLHILAAC-P | SEQ ID NO: 215 |
| 054_KK | LAEAKVLANRELDKY-GKSDYYKNLINKAKTVEGVEALTLHILAAK-P | SEQ ID NO: 216 |
| 055_CK | LAEAKVLANRELDKY-GCSDFYKNLINRAKTVEGVDALIAHILAAK-P | SEQ ID NO: 217 |
| 055_KC | LAEAKVLANRELDKY-GKSDFYKNLINRAKTVEGVDALIAHILAAC-P | SEQ ID NO: 218 |
| 055_CC | LAEAKVLANRELDKY-GCSDFYKNLINRAKTVEGVDALIAHILAAC-P | SEQ ID NO: 219 |
| 055_KK | LAEAKVLANRELDKY-GKSDFYKNLINRAKTVEGVDALIAHILAAK-P | SEQ ID NO: 220 |
| 056_CK | LAEAKVLANRELDKY-GCSDYYKNLINKAKTVEGVQALIAHILAAK-P | SEQ ID NO: 221 |
| 056_KC | LAEAKVLANRELDKY-GKSDYYKNLINKAKTVEGVQALIAHILAAC-P | SEQ ID NO: 222 |
| 056_CC | LAEAKVLANRELDKY-GCSDYYKNLINKAKTVEGVQALIAHILAAC-P | SEQ ID NO: 223 |
| 056_KK | LAEAKVLANRELDKY-GKSDYYKNLINKAKTVEGVQALIAHILAAK-P | SEQ ID NO: 224 |
| 057_CK | LAEAKVLANRELDKY-GCSDFYKRLINRAKTVEGVHALIGHILAAK-P | SEQ ID NO: 225 |
| 057_KC | LAEAKVLANRELDKY-GKSDFYKRLINRAKTVEGVHALIGHILAAC-P | SEQ ID NO: 226 |
| 057_CC | LAEAKVLANRELDKY-GCSDFYKRLINRAKTVEGVHALIGHILAAC-P | SEQ ID NO: 227 |
| 057_KK | LAEAKVLANRELDKY-GKSDFYKRLINRAKTVEGVHALIGHILAAK-P | SEQ ID NO: 228 |
| 058_CK | LAEAKVLANRELDKY-GCSDFYKRVINRAKTVEGVHALIDHILAAK-P | SEQ ID NO: 229 |
| 058_KC | LAEAKVLANRELDKY-GKSDFYKRVINRAKTVEGVHALIDHILAAC-P | SEQ ID NO: 230 |
| 058_CC | LAEAKVLANRELDKY-GCSDFYKRVINRAKTVEGVHALIDHILAAC-P | SEQ ID NO: 231 |
| 058_KK | LAEAKVLANRELDKY-GKSDFYKRVINRAKTVEGVHALIDHILAAK-P | SEQ ID NO: 232 |
| 059_CK | LAEAKVLANRELDKY-GCSDYYKRIINRAKTVEGVRALKLHILAAK-P | SEQ ID NO: 233 |
| 059_KC | LAEAKVLANRELDKY-GKSDYYKRIINRAKTVEGVRALKLHILAAC-P | SEQ ID NO: 234 |

Figure 1J

| Designation | Amino acid sequence | SEQ ID NO |
|---|---|---|
| 059_CC | LAEAKVLANRELDKY-GCSDYYKRIINRAKTVEGVRALKLHILAAC-P | SEQ ID NO: 235 |
| 059_KK | LAEAKVLANRELDKY-GKSDYYKRIINRAKTVEGVRALKLHILAAK-P | SEQ ID NO: 236 |
| 060_CK | LAEAKVLANRELDKY-GCSDFYKRVINRAKTVEGVSALIHEILAAK-P | SEQ ID NO: 237 |
| 060_KC | LAEAKVLANRELDKY-GKSDFYKRVINRAKTVEGVSALIHEILAAC-P | SEQ ID NO: 238 |
| 060_CC | LAEAKVLANRELDKY-GCSDFYKRVINRAKTVEGVSALIHEILAAC-P | SEQ ID NO: 239 |
| 060_KK | LAEAKVLANRELDKY-GKSDFYKRVINRAKTVEGVSALIHEILAAK-P | SEQ ID NO: 240 |
| 061_CK | LAEAKVLANRELDKY-GCSDYYKRLINRAKTVEGVNSLISHILAAK-P | SEQ ID NO: 241 |
| 061_KC | LAEAKVLANRELDKY-GKSDYYKRLINRAKTVEGVNSLISHILAAC-P | SEQ ID NO: 242 |
| 061_CC | LAEAKVLANRELDKY-GCSDYYKRLINRAKTVEGVNSLISHILAAC-P | SEQ ID NO: 243 |
| 061_KK | LAEAKVLANRELDKY-GKSDYYKRLINRAKTVEGVNSLISHILAAK-P | SEQ ID NO: 244 |
| 062_CK | LAEAKVLANRELDKY-GCSDFYKRLINRAKTVEGVSSLKGHILAAK-P | SEQ ID NO: 245 |
| 062_KC | LAEAKVLANRELDKY-GKSDFYKRLINRAKTVEGVSSLKGHILAAC-P | SEQ ID NO: 246 |
| 062_CC | LAEAKVLANRELDKY-GCSDFYKRLINRAKTVEGVSSLKGHILAAC-P | SEQ ID NO: 247 |
| 062_KK | LAEAKVLANRELDKY-GKSDFYKRLINRAKTVEGVSSLKGHILAAK-P | SEQ ID NO: 248 |
| 063_CK | LAEAKVLANRELDKY-GCSDFYKRVINRAKTVEGVDSLIAEILAAK-P | SEQ ID NO: 249 |
| 063_KC | LAEAKVLANRELDKY-GKSDFYKRVINRAKTVEGVDSLIAEILAAC-P | SEQ ID NO: 250 |
| 063_CC | LAEAKVLANRELDKY-GCSDFYKRVINRAKTVEGVDSLIAEILAAC-P | SEQ ID NO: 251 |
| 063_KK | LAEAKVLANRELDKY-GKSDFYKRVINRAKTVEGVDSLIAEILAAK-P | SEQ ID NO: 252 |
| 064_CK | LAEAKVLANRELDKY-GCSDFYKRLINRARTVEGVQTLISDILAAK-P | SEQ ID NO: 253 |
| 064_KC | LAEAKVLANRELDKY-GKSDFYKRLINRARTVEGVQTLISDILAAC-P | SEQ ID NO: 254 |
| 064_CC | LAEAKVLANRELDKY-GCSDFYKRLINRARTVEGVQTLISDILAAC-P | SEQ ID NO: 255 |
| 064_KK | LAEAKVLANRELDKY-GKSDFYKRLINRARTVEGVQTLISDILAAK-P | SEQ ID NO: 256 |
| 065_CK | LAEAKVLANRELDKY-GCSDFYKRFINKAKTVEGVETLISEILAAK-P | SEQ ID NO: 257 |
| 065_KC | LAEAKVLANRELDKY-GKSDFYKRFINKAKTVEGVETLISEILAAC-P | SEQ ID NO: 258 |
| 065_CC | LAEAKVLANRELDKY-GCSDFYKRFINKAKTVEGVETLISEILAAC-P | SEQ ID NO: 259 |
| 065_KK | LAEAKVLANRELDKY-GKSDFYKRFINKAKTVEGVETLISEILAAK-P | SEQ ID NO: 260 |

Figure 1K

| Designation | Amino acid sequence | SEQ ID NO |
|---|---|---|
| 066_CK | LAEAKVLANRELDKY-GCSDFYKRLINRAKTVEGVHSLTDEILAAK-P | SEQ ID NO: 261 |
| 066_KC | LAEAKVLANRELDKY-GKSDFYKRLINRAKTVEGVHSLTDEILAAC-P | SEQ ID NO: 262 |
| 066_CC | LAEAKVLANRELDKY-GCSDFYKRLINRAKTVEGVHSLTDEILAAC-P | SEQ ID NO: 263 |
| 066_KK | LAEAKVLANRELDKY-GKSDFYKRLINRAKTVEGVHSLTDEILAAK-P | SEQ ID NO: 264 |
| 067_CK | LAEAKVLANRELDKY-GCSDYYKRVINKAKTVEGVSSLTAEILAAK-P | SEQ ID NO: 265 |
| 067_KC | LAEAKVLANRELDKY-GKSDYYKRVINKAKTVEGVSSLTAEILAAC-P | SEQ ID NO: 266 |
| 067_CC | LAEAKVLANRELDKY-GCSDYYKRVINKAKTVEGVSSLTAEILAAC-P | SEQ ID NO: 267 |
| 067_KK | LAEAKVLANRELDKY-GKSDYYKRVINKAKTVEGVSSLTAEILAAK-P | SEQ ID NO: 268 |
| 068_CK | LAEAKVLANRELDKY-GCSDFYKRLINRAKTVEGVDALTSHILAAK-P | SEQ ID NO: 269 |
| 068_KC | LAEAKVLANRELDKY-GKSDFYKRLINRAKTVEGVDALTSHILAAC-P | SEQ ID NO: 270 |
| 068_CC | LAEAKVLANRELDKY-GCSDFYKRLINRAKTVEGVDALTSHILAAC-P | SEQ ID NO: 271 |
| 068_KK | LAEAKVLANRELDKY-GKSDFYKRLINRAKTVEGVDALTSHILAAK-P | SEQ ID NO: 272 |
| 069_CK | LAEAKVLANRELDKY-GCSDFYKRLINKAKTVEGVSTLIHDILAAK-P | SEQ ID NO: 273 |
| 069_KC | LAEAKVLANRELDKY-GKSDFYKRLINKAKTVEGVSTLIHDILAAC-P | SEQ ID NO: 274 |
| 069_CC | LAEAKVLANRELDKY-GCSDFYKRLINKAKTVEGVSTLIHDILAAC-P | SEQ ID NO: 275 |
| 069_KK | LAEAKVLANRELDKY-GKSDFYKRLINKAKTVEGVSTLIHDILAAK-P | SEQ ID NO: 276 |
| 070_CK | LAEAKVLANRELDKY-GCSDFYKRLINRAKTVEGVSTLIHDILAAK-P | SEQ ID NO: 277 |
| 070_KC | LAEAKVLANRELDKY-GKSDFYKRLINRAKTVEGVSTLIHDILAAC-P | SEQ ID NO: 278 |
| 070_CC | LAEAKVLANRELDKY-GCSDFYKRLINRAKTVEGVSTLIHDILAAC-P | SEQ ID NO: 279 |
| 070_KK | LAEAKVLANRELDKY-GKSDFYKRLINRAKTVEGVSTLIHDILAAK-P | SEQ ID NO: 280 |
| 071_CK | LAEAKVLANRELDKY-GCSDFYKRLINRAKTVEGVQALISEILAAK-P | SEQ ID NO: 281 |
| 071_KC | LAEAKVLANRELDKY-GKSDFYKRLINRAKTVEGVQALISEILAAC-P | SEQ ID NO: 282 |
| 071_CC | LAEAKVLANRELDKY-GCSDFYKRLINRAKTVEGVQALISEILAAC-P | SEQ ID NO: 283 |
| 071_KK | LAEAKVLANRELDKY-GKSDFYKRLINRAKTVEGVQALISEILAAK-P | SEQ ID NO: 284 |
| 072_CK | LAEAKVLANRELDKY-GCSDYYKRLINKAKTVEGVDSLIVHILAAK-P | SEQ ID NO: 285 |
| 072_KC | LAEAKVLANRELDKY-GKSDYYKRLINKAKTVEGVDSLIVHILAAC-P | SEQ ID NO: 286 |

Figure 1L

| Designation | Amino acid sequence | SEQ ID NO |
|---|---|---|
| 072_CC | LAEAKVLANRELDKY-GCSDYYKRLINKAKTVEGVDSLIVHILAAC-P | SEQ ID NO: 287 |
| 072_KK | LAEAKVLANRELDKY-GKSDYYKRLINKAKTVEGVDSLIVHILAAK-P | SEQ ID NO: 288 |
| 073_CK | LAEAKVLANRELDKY-GCSDFYKRLINRAKTVEGVQSLITEILAAK-P | SEQ ID NO: 289 |
| 073_KC | LAEAKVLANRELDKY-GKSDFYKRLINRAKTVEGVQSLITEILAAC-P | SEQ ID NO: 290 |
| 073_CC | LAEAKVLANRELDKY-GCSDFYKRLINRAKTVEGVQSLITEILAAC-P | SEQ ID NO: 291 |
| 073_KK | LAEAKVLANRELDKY-GKSDFYKRLINRAKTVEGVQSLITEILAAK-P | SEQ ID NO: 292 |
| 074_CK | LAEAKVLANRELDKY-GCSDYYKRLINRAKTVEGVDALITHILAAK-P | SEQ ID NO: 293 |
| 074_KC | LAEAKVLANRELDKY-GKSDYYKRLINRAKTVEGVDALITHILAAC-P | SEQ ID NO: 294 |
| 074_CC | LAEAKVLANRELDKY-GCSDYYKRLINRAKTVEGVDALITHILAAC-P | SEQ ID NO: 295 |
| 074_KK | LAEAKVLANRELDKY-GKSDYYKRLINRAKTVEGVDALITHILAAK-P | SEQ ID NO: 296 |
| 075_CK | LAEAKVLANRELDKY-GCSDFYKRMINRAKTVEGVDSLITHILAAK-P | SEQ ID NO: 297 |
| 075_KC | LAEAKVLANRELDKY-GKSDFYKRMINRAKTVEGVDSLITHILAAC-P | SEQ ID NO: 298 |
| 075_CC | LAEAKVLANRELDKY-GCSDFYKRMINRAKTVEGVDSLITHILAAC-P | SEQ ID NO: 299 |
| 075_KK | LAEAKVLANRELDKY-GKSDFYKRMINRAKTVEGVDSLITHILAAK-P | SEQ ID NO: 300 |
| 076_CK | LAEAKVLANRELDKY-GCSDFYKRLINRAKTVEGVTTLTTDILAAK-P | SEQ ID NO: 301 |
| 076_KC | LAEAKVLANRELDKY-GKSDFYKRLINRAKTVEGVTTLTTDILAAC-P | SEQ ID NO: 302 |
| 076_CC | LAEAKVLANRELDKY-GCSDFYKRLINRAKTVEGVTTLTTDILAAC-P | SEQ ID NO: 303 |
| 076_KK | LAEAKVLANRELDKY-GKSDFYKRLINRAKTVEGVTTLTTDILAAK-P | SEQ ID NO: 304 |
| 077_CK | LAEAKVLANRELDKY-GCSDFYKRLINRAKTVEGVESLIDHILAAK-P | SEQ ID NO: 305 |
| 077_KC | LAEAKVLANRELDKY-GKSDFYKRLINRAKTVEGVESLIDHILAAC-P | SEQ ID NO: 306 |
| 077_CC | LAEAKVLANRELDKY-GCSDFYKRLINRAKTVEGVESLIDHILAAC-P | SEQ ID NO: 307 |
| 077_KK | LAEAKVLANRELDKY-GKSDFYKRLINRAKTVEGVESLIDHILAAK-P | SEQ ID NO: 308 |
| 078_CK | LAEAKVLANRELDKY-GCSDFYKRYINRAKTVEGVHTLIGHILAAK-P | SEQ ID NO: 309 |
| 078_KC | LAEAKVLANRELDKY-GKSDFYKRYINRAKTVEGVHTLIGHILAAC-P | SEQ ID NO: 310 |
| 078_CC | LAEAKVLANRELDKY-GCSDFYKRYINRAKTVEGVHTLIGHILAAC-P | SEQ ID NO: 311 |
| 078_KK | LAEAKVLANRELDKY-GKSDFYKRYINRAKTVEGVHTLIGHILAAK-P | SEQ ID NO: 312 |

Figure 1M

| Designation | Amino acid sequence | SEQ ID NO |
|---|---|---|
| 079_CK | LAEAKVLANRELDKY-GCSDFYKRLINRAKTVEGVQTLISDILAAK-P | SEQ ID NO: 313 |
| 079_KC | LAEAKVLANRELDKY-GKSDFYKRLINRAKTVEGVQTLISDILAAC-P | SEQ ID NO: 314 |
| 079_CC | LAEAKVLANRELDKY-GCSDFYKRLINRAKTVEGVQTLISDILAAC-P | SEQ ID NO: 315 |
| 079_KK | LAEAKVLANRELDKY-GKSDFYKRLINRAKTVEGVQTLISDILAAK-P | SEQ ID NO: 316 |
| 080_CK | LAEAKVLANRELDKY-GCSDFYKRLINRAKTVEGVNSLTSHILAAK-P | SEQ ID NO: 317 |
| 080_KC | LAEAKVLANRELDKY-GKSDFYKRLINRAKTVEGVNSLTSHILAAC-P | SEQ ID NO: 318 |
| 080_CC | LAEAKVLANRELDKY-GCSDFYKRLINRAKTVEGVNSLTSHILAAC-P | SEQ ID NO: 319 |
| 080_KK | LAEAKVLANRELDKY-GKSDFYKRLINRAKTVEGVNSLTSHILAAK-P | SEQ ID NO: 320 |
| 081_CK | LAEAKVLANRELDKY-GCSDFYKRLINRAKTVEGVNTLIHDILAAK-P | SEQ ID NO: 321 |
| 081_KC | LAEAKVLANRELDKY-GKSDFYKRLINRAKTVEGVNTLIHDILAAC-P | SEQ ID NO: 322 |
| 081_CC | LAEAKVLANRELDKY-GCSDFYKRLINRAKTVEGVNTLIHDILAAC-P | SEQ ID NO: 323 |
| 081_KK | LAEAKVLANRELDKY-GKSDFYKRLINRAKTVEGVNTLIHDILAAK-P | SEQ ID NO: 324 |
| 082_CK | LAEAKVLANRELDKY-GCSDFYKRLINRAKTVEGVESLIGEILAAK-P | SEQ ID NO: 325 |
| 082_KC | LAEAKVLANRELDKY-GKSDFYKRLINRAKTVEGVESLIGEILAAC-P | SEQ ID NO: 326 |
| 082_CC | LAEAKVLANRELDKY-GCSDFYKRLINRAKTVEGVESLIGEILAAC-P | SEQ ID NO: 327 |
| 082_KK | LAEAKVLANRELDKY-GKSDFYKRLINRAKTVEGVESLIGEILAAK-P | SEQ ID NO: 328 |
| 083_CK | LAEAKVLANRELDKY-GCSDFYKRLINKAKTVEGVHTLIHDILAAK-P | SEQ ID NO: 329 |
| 083_KC | LAEAKVLANRELDKY-GKSDFYKRLINKAKTVEGVHTLIHDILAAC-P | SEQ ID NO: 330 |
| 083_CC | LAEAKVLANRELDKY-GCSDFYKRLINKAKTVEGVHTLIHDILAAC-P | SEQ ID NO: 331 |
| 083_KK | LAEAKVLANRELDKY-GKSDFYKRLINKAKTVEGVHTLIHDILAAK-P | SEQ ID NO: 332 |
| 084_CK | LAEAKVLANRELDKY-GCSDYYKRLINKAKTVEGVSALKMHILAAK-P | SEQ ID NO: 333 |
| 084_KC | LAEAKVLANRELDKY-GKSDYYKRLINKAKTVEGVSALKMHILAAC-P | SEQ ID NO: 334 |
| 084_CC | LAEAKVLANRELDKY-GCSDYYKRLINKAKTVEGVSALKMHILAAC-P | SEQ ID NO: 335 |
| 084_KK | LAEAKVLANRELDKY-GKSDYYKRLINKAKTVEGVSALKMHILAAK-P | SEQ ID NO: 336 |
| 085_CK | LAEAKVLANRELDKY-GCSDFYKRLINKAKTVEGVDALIVHILAAK-P | SEQ ID NO: 337 |
| 085_KC | LAEAKVLANRELDKY-GKSDFYKRLINKAKTVEGVDALIVHILAAC-P | SEQ ID NO: 338 |

Figure 1N

| Designation | Amino acid sequence | SEQ ID NO |
|---|---|---|
| 085_CC | LAEAKVLANRELDKY-GCSDFYKRLINKAKTVEGVDALIVHILAAC-P | SEQ ID NO: 339 |
| 085_KK | LAEAKVLANRELDKY-GKSDFYKRLINKAKTVEGVDALIVHILAAK-P | SEQ ID NO: 340 |
| 086_CK | LAEAKVLANRELDKY-GCSDYYKRLINRARTVEGVDTLIHDILAAK-P | SEQ ID NO: 341 |
| 086_KC | LAEAKVLANRELDKY-GKSDYYKRLINRARTVEGVDTLIHDILAAC-P | SEQ ID NO: 342 |
| 086_CC | LAEAKVLANRELDKY-GCSDYYKRLINRARTVEGVDTLIHDILAAC-P | SEQ ID NO: 343 |
| 086_KK | LAEAKVLANRELDKY-GKSDYYKRLINRARTVEGVDTLIHDILAAK-P | SEQ ID NO: 344 |
| 087_CK | LAEAKVLANRELDKY-GCSDFYKRVINRARTVEGVQALIADILAAK-P | SEQ ID NO: 345 |
| 087_KC | LAEAKVLANRELDKY-GKSDFYKRVINRARTVEGVQALIADILAAC-P | SEQ ID NO: 346 |
| 087_CC | LAEAKVLANRELDKY-GCSDFYKRVINRARTVEGVQALIADILAAC-P | SEQ ID NO: 347 |
| 087_KK | LAEAKVLANRELDKY-GKSDFYKRVINRARTVEGVQALIADILAAK-P | SEQ ID NO: 348 |
| 088_CK | LAEAKVLANRELDKY-GCSDFYKRLINRAKTVEGVESLIADILAAK-P | SEQ ID NO: 349 |
| 088_KC | LAEAKVLANRELDKY-GKSDFYKRLINRAKTVEGVESLIADILAAC-P | SEQ ID NO: 350 |
| 088_CC | LAEAKVLANRELDKY-GCSDFYKRLINRAKTVEGVESLIADILAAC-P | SEQ ID NO: 351 |
| 088_KK | LAEAKVLANRELDKY-GKSDFYKRLINRAKTVEGVESLIADILAAK-P | SEQ ID NO: 352 |
| 089_CK | LAEAKVLANRELDKY-GCSDFYKRLINKAKTVEGVDALIAHILAAK-P | SEQ ID NO: 353 |
| 089_KC | LAEAKVLANRELDKY-GKSDFYKRLINKAKTVEGVDALIAHILAAC-P | SEQ ID NO: 354 |
| 089_CC | LAEAKVLANRELDKY-GCSDFYKRLINKAKTVEGVDALIAHILAAC-P | SEQ ID NO: 355 |
| 089_KK | LAEAKVLANRELDKY-GKSDFYKRLINKAKTVEGVDALIAHILAAK-P | SEQ ID NO: 356 |
| 090_CK | LAEAKVLANRELDKY-GCSDYYKRLINRAKTVEGVESLITHILAAK-P | SEQ ID NO: 357 |
| 090_KC | LAEAKVLANRELDKY-GKSDYYKRLINRAKTVEGVESLITHILAAC-P | SEQ ID NO: 358 |
| 090_CC | LAEAKVLANRELDKY-GCSDYYKRLINRAKTVEGVESLITHILAAC-P | SEQ ID NO: 359 |
| 090_KK | LAEAKVLANRELDKY-GKSDYYKRLINRAKTVEGVESLITHILAAK-P | SEQ ID NO: 360 |
| 091_CK | LAEAKVLANRELDKY-GCSDFYKRLINRARTVEGVDSLIVEILAAK-P | SEQ ID NO: 361 |
| 091_KC | LAEAKVLANRELDKY-GKSDFYKRLINRARTVEGVDSLIVEILAAC-P | SEQ ID NO: 362 |
| 091_CC | LAEAKVLANRELDKY-GCSDFYKRLINRARTVEGVDSLIVEILAAC-P | SEQ ID NO: 363 |
| 091_KK | LAEAKVLANRELDKY-GKSDFYKRLINRARTVEGVDSLIVEILAAK-P | SEQ ID NO: 364 |

Figure 10

| Designation | Amino acid sequence | SEQ ID NO |
|---|---|---|
| 092 CK | LAEAKVLANRELDKY-GCSDFYKRVINRAKTVEGVSALIREILAAK-P | SEQ ID NO: 365 |
| 092 KC | LAEAKVLANRELDKY-GKSDFYKRVINRAKTVEGVSALIREILAAC-P | SEQ ID NO: 366 |
| 092 CC | LAEAKVLANRELDKY-GCSDFYKRVINRAKTVEGVSALIREILAAC-P | SEQ ID NO: 367 |
| 092 KK | LAEAKVLANRELDKY-GKSDFYKRVINRAKTVEGVSALIREILAAK-P | SEQ ID NO: 368 |
| 093 CK | LAEAKVLANRELDKY-GCSDFYKRLINRAKTVEGVNALISDILAAK-P | SEQ ID NO: 369 |
| 093 KC | LAEAKVLANRELDKY-GKSDFYKRLINRAKTVEGVNALISDILAAC-P | SEQ ID NO: 370 |
| 093 CC | LAEAKVLANRELDKY-GCSDFYKRLINRAKTVEGVNALISDILAAC-P | SEQ ID NO: 371 |
| 093 KK | LAEAKVLANRELDKY-GKSDFYKRLINRAKTVEGVNALISDILAAK-P | SEQ ID NO: 372 |
| 094 CK | LAEAKVLANRELDKY-GCSDFYKRLINRAKTVEGVSALIQEILAAK-P | SEQ ID NO: 373 |
| 094 KC | LAEAKVLANRELDKY-GKSDFYKRLINRAKTVEGVSALIQEILAAC-P | SEQ ID NO: 374 |
| 094 CC | LAEAKVLANRELDKY-GCSDFYKRLINRAKTVEGVSALIQEILAAC-P | SEQ ID NO: 375 |
| 094 KK | LAEAKVLANRELDKY-GKSDFYKRLINRAKTVEGVSALIQEILAAK-P | SEQ ID NO: 376 |
| 095 CK | LAEAKVLANRELDKY-GCSDFYKRLINRAKTVEGVQSLIDHILAAK-P | SEQ ID NO: 377 |
| 095 KC | LAEAKVLANRELDKY-GKSDFYKRLINRAKTVEGVQSLIDHILAAC-P | SEQ ID NO: 378 |
| 095 CC | LAEAKVLANRELDKY-GCSDFYKRLINRAKTVEGVQSLIDHILAAC-P | SEQ ID NO: 379 |
| 095 KK | LAEAKVLANRELDKY-GKSDFYKRLINRAKTVEGVQSLIDHILAAK-P | SEQ ID NO: 380 |
| 096 CK | LAEAKVLANRELDKY-GCSDFYKRLINRAKTVEGVDALICHILAAK-P | SEQ ID NO: 381 |
| 096 KC | LAEAKVLANRELDKY-GKSDFYKRLINRAKTVEGVDALICHILAAC-P | SEQ ID NO: 382 |
| 096 CC | LAEAKVLANRELDKY-GCSDFYKRLINRAKTVEGVDALICHILAAC-P | SEQ ID NO: 383 |
| 096 KK | LAEAKVLANRELDKY-GKSDFYKRLINRAKTVEGVDALICHILAAK-P | SEQ ID NO: 384 |
| 097 CK | LAEAKVLANRELDKY-GCSDFYKRVINKAKTVEGVEALIADILAAK-P | SEQ ID NO: 385 |
| 097 KC | LAEAKVLANRELDKY-GKSDFYKRVINKAKTVEGVEALIADILAAC-P | SEQ ID NO: 386 |
| 097 CC | LAEAKVLANRELDKY-GCSDFYKRVINKAKTVEGVEALIADILAAC-P | SEQ ID NO: 387 |
| 097 KK | LAEAKVLANRELDKY-GKSDFYKRVINKAKTVEGVEALIADILAAK-P | SEQ ID NO: 388 |
| 098 CK | LAEAKVLANRELDKY-GCSDFYKRLINRAKTVEGVETLIRDILAAK-P | SEQ ID NO: 389 |
| 098 KC | LAEAKVLANRELDKY-GKSDFYKRLINRAKTVEGVETLIRDILAAC-P | SEQ ID NO: 390 |

Figure 1P

| Designation | Amino acid sequence | SEQ ID NO |
|---|---|---|
| 098_CC | LAEAKVLANRELDKY-GCSDFYKRLINRAKTVEGVETLIRDILAAC-P | SEQ ID NO: 391 |
| 098_KK | LAEAKVLANRELDKY-GKSDFYKRLINRAKTVEGVETLIRDILAAK-P | SEQ ID NO: 392 |
| 099_CK | LAEAKVLANRELDKY-GCSDFYKRLINRARTVEGVQTLITDILAAK-P | SEQ ID NO: 393 |
| 099_KC | LAEAKVLANRELDKY-GKSDFYKRLINRARTVEGVQTLITDILAAC-P | SEQ ID NO: 394 |
| 099_CC | LAEAKVLANRELDKY-GCSDFYKRLINRARTVEGVQTLITDILAAC-P | SEQ ID NO: 395 |
| 099_KK | LAEAKVLANRELDKY-GKSDFYKRLINRARTVEGVQTLITDILAAK-P | SEQ ID NO: 396 |
| 100_CK | LAEAKVLANRELDKY-GCSDYYKRLINRAKTVEGVQALIAHILAAK-P | SEQ ID NO: 397 |
| 100_KC | LAEAKVLANRELDKY-GKSDYYKRLINRAKTVEGVQALIAHILAAC-P | SEQ ID NO: 398 |
| 100_CC | LAEAKVLANRELDKY-GCSDYYKRLINRAKTVEGVQALIAHILAAC-P | SEQ ID NO: 399 |
| 100_KK | LAEAKVLANRELDKY-GKSDYYKRLINRAKTVEGVQALIAHILAAK-P | SEQ ID NO: 400 |
| 101_CK | LAEAKVLANRELDKY-GCSDFYKRVINRAKTVEGVNSLINHILAAK-P | SEQ ID NO: 401 |
| 101_KC | LAEAKVLANRELDKY-GKSDFYKRVINRAKTVEGVNSLINHILAAC-P | SEQ ID NO: 402 |
| 101_CC | LAEAKVLANRELDKY-GCSDFYKRVINRAKTVEGVNSLINHILAAC-P | SEQ ID NO: 403 |
| 101_KK | LAEAKVLANRELDKY-GKSDFYKRVINRAKTVEGVNSLINHILAAK-P | SEQ ID NO: 404 |
| 102_CK | LAEAKVLANRELDKY-GCSDFYKRLINRARTVEGVDSLIRHILAAK-P | SEQ ID NO: 405 |
| 102_KC | LAEAKVLANRELDKY-GKSDFYKRLINRARTVEGVDSLIRHILAAC-P | SEQ ID NO: 406 |
| 102_CC | LAEAKVLANRELDKY-GCSDFYKRLINRARTVEGVDSLIRHILAAC-P | SEQ ID NO: 407 |
| 102_KK | LAEAKVLANRELDKY-GKSDFYKRLINRARTVEGVDSLIRHILAAK-P | SEQ ID NO: 408 |
| 103_CK | LAEAKVLANRELDKY-GCSDYYKRLINKAKTVEGVEALTLHILAAK-P | SEQ ID NO: 409 |
| 103_KC | LAEAKVLANRELDKY-GKSDYYKRLINKAKTVEGVEALTLHILAAC-P | SEQ ID NO: 410 |
| 103_CC | LAEAKVLANRELDKY-GCSDYYKRLINKAKTVEGVEALTLHILAAC-P | SEQ ID NO: 411 |
| 103_KK | LAEAKVLANRELDKY-GKSDYYKRLINKAKTVEGVEALTLHILAAK-P | SEQ ID NO: 412 |
| 104_CK | LAEAKVLANRELDKY-GCSDFYKRLINRAKTVEGVDALIAHILAAK-P | SEQ ID NO: 413 |
| 104_KC | LAEAKVLANRELDKY-GKSDFYKRLINRAKTVEGVDALIAHILAAC-P | SEQ ID NO: 414 |
| 104_CC | LAEAKVLANRELDKY-GCSDFYKRLINRAKTVEGVDALIAHILAAC-P | SEQ ID NO: 415 |
| 104_KK | LAEAKVLANRELDKY-GKSDFYKRLINRAKTVEGVDALIAHILAAK-P | SEQ ID NO: 416 |

Figure 1Q

| Designation | Amino acid sequence | SEQ ID NO |
|---|---|---|
| 105_CK | LAEAKVLANRELDKY-GCSDYYKRLINKAKTVEGVQALIAHILAAK-P | SEQ ID NO: 417 |
| 105_KC | LAEAKVLANRELDKY-GKSDYYKRLINKAKTVEGVQALIAHILAAC-P | SEQ ID NO: 418 |
| 105_CC | LAEAKVLANRELDKY-GCSDYYKRLINKAKTVEGVQALIAHILAAC-P | SEQ ID NO: 419 |
| 105_KK | LAEAKVLANRELDKY-GKSDYYKRLINKAKTVEGVQALIAHILAAK-P | SEQ ID NO: 420 |
| 106_CK | LAEAKVLANRELDKY-GCSDFYKNLINRAKTVEGVHALKGHILAAK-P | SEQ ID NO: 421 |
| 106_KC | LAEAKVLANRELDKY-GKSDFYKNLINRAKTVEGVHALKGHILAAC-P | SEQ ID NO: 422 |
| 106_CC | LAEAKVLANRELDKY-GCSDFYKNLINRAKTVEGVHALKGHILAAC-P | SEQ ID NO: 423 |
| 106_KK | LAEAKVLANRELDKY-GKSDFYKNLINRAKTVEGVHALKGHILAAK-P | SEQ ID NO: 424 |
| 107_CK | LAEAKVLANRELDKY-GCSDFYKNVINRAKTVEGVHALKDHILAAK-P | SEQ ID NO: 425 |
| 107_KC | LAEAKVLANRELDKY-GKSDFYKNVINRAKTVEGVHALKDHILAAC-P | SEQ ID NO: 426 |
| 107_CC | LAEAKVLANRELDKY-GCSDFYKNVINRAKTVEGVHALKDHILAAC-P | SEQ ID NO: 427 |
| 107_KK | LAEAKVLANRELDKY-GKSDFYKNVINRAKTVEGVHALKDHILAAK-P | SEQ ID NO: 428 |
| 108_CK | LAEAKVLANRELDKY-GCSDFYKNVINRAKTVEGVSALKHEILAAK-P | SEQ ID NO: 429 |
| 108_KC | LAEAKVLANRELDKY-GKSDFYKNVINRAKTVEGVSALKHEILAAC-P | SEQ ID NO: 430 |
| 108_CC | LAEAKVLANRELDKY-GCSDFYKNVINRAKTVEGVSALKHEILAAC-P | SEQ ID NO: 431 |
| 108_KK | LAEAKVLANRELDKY-GKSDFYKNVINRAKTVEGVSALKHEILAAK-P | SEQ ID NO: 432 |
| 109_CK | LAEAKVLANRELDKY-GCSDFYKRLINRAKTVEGVNTLKADILAAK-P | SEQ ID NO: 433 |
| 109_KC | LAEAKVLANRELDKY-GKSDFYKRLINRAKTVEGVNTLKADILAAC-P | SEQ ID NO: 434 |
| 109_CC | LAEAKVLANRELDKY-GCSDFYKRLINRAKTVEGVNTLKADILAAC-P | SEQ ID NO: 435 |
| 109_KK | LAEAKVLANRELDKY-GKSDFYKRLINRAKTVEGVNTLKADILAAK-P | SEQ ID NO: 436 |
| 110_CK | LAEAKVLANRELDKY-GCSDFYKNLINRAKTVEGVNTLKADILAAK-P | SEQ ID NO: 437 |
| 110_KC | LAEAKVLANRELDKY-GKSDFYKNLINRAKTVEGVNTLKADILAAC-P | SEQ ID NO: 438 |
| 110_CC | LAEAKVLANRELDKY-GCSDFYKNLINRAKTVEGVNTLKADILAAC-P | SEQ ID NO: 439 |
| 110_KK | LAEAKVLANRELDKY-GKSDFYKNLINRAKTVEGVNTLKADILAAK-P | SEQ ID NO: 440 |
| 111_CK | LAEAKVLANRELDKY-GCSDYYKNLINRAKTVEGVNSLKSHILAAK-P | SEQ ID NO: 441 |
| 111_KC | LAEAKVLANRELDKY-GKSDYYKNLINRAKTVEGVNSLKSHILAAC-P | SEQ ID NO: 442 |

Figure 1R

| Designation | Amino acid sequence | SEQ ID NO |
|---|---|---|
| 111_CC | LAEAKVLANRELDKY-GCSDYYKNLINRAKTVEGVNSLKSHILAAC-P | SEQ ID NO: 443 |
| 111_KK | LAEAKVLANRELDKY-GKSDYYKNLINRAKTVEGVNSLKSHILAAK-P | SEQ ID NO: 444 |
| 112_CK | LAEAKVLANRELDKY-GCSDFYKRLINRAKTVGGVQSLKSEILAAK-P | SEQ ID NO: 445 |
| 112_KC | LAEAKVLANRELDKY-GKSDFYKRLINRAKTVGGVQSLKSEILAAC-P | SEQ ID NO: 446 |
| 112_CC | LAEAKVLANRELDKY-GCSDFYKRLINRAKTVGGVQSLKSEILAAC-P | SEQ ID NO: 447 |
| 112_KK | LAEAKVLANRELDKY-GKSDFYKRLINRAKTVGGVQSLKSEILAAK-P | SEQ ID NO: 448 |
| 113_CK | LAEAKVLANRELDKY-GCSDFYKNVINRAKTVEGVDSLKAEILAAK-P | SEQ ID NO: 449 |
| 113_KC | LAEAKVLANRELDKY-GKSDFYKNVINRAKTVEGVDSLKAEILAAC-P | SEQ ID NO: 450 |
| 113_CC | LAEAKVLANRELDKY-GCSDFYKNVINRAKTVEGVDSLKAEILAAC-P | SEQ ID NO: 451 |
| 113_KK | LAEAKVLANRELDKY-GKSDFYKNVINRAKTVEGVDSLKAEILAAK-P | SEQ ID NO: 452 |
| 114_CK | LAEAKVLANRELDKY-GCSDFYKNLINRARTVEGVQTLKSDILAAK-P | SEQ ID NO: 453 |
| 114_KC | LAEAKVLANRELDKY-GKSDFYKNLINRARTVEGVQTLKSDILAAC-P | SEQ ID NO: 454 |
| 114_CC | LAEAKVLANRELDKY-GCSDFYKNLINRARTVEGVQTLKSDILAAC-P | SEQ ID NO: 455 |
| 114_KK | LAEAKVLANRELDKY-GKSDFYKNLINRARTVEGVQTLKSDILAAK-P | SEQ ID NO: 456 |
| 115_CK | LAEAKVLANRELDKY-GCSDFYKKFINKAKTVEGVETLKSEILAAK-P | SEQ ID NO: 457 |
| 115_KC | LAEAKVLANRELDKY-GKSDFYKKFINKAKTVEGVETLKSEILAAC-P | SEQ ID NO: 458 |
| 115_CC | LAEAKVLANRELDKY-GCSDFYKKFINKAKTVEGVETLKSEILAAC-P | SEQ ID NO: 459 |
| 115_KK | LAEAKVLANRELDKY-GKSDFYKKFINKAKTVEGVETLKSEILAAK-P | SEQ ID NO: 460 |
| 116_CK | LAEAKVLANRELDKY-GCSDFYKSLINRAKTVEGVHSLKDEILAAK-P | SEQ ID NO: 461 |
| 116_KC | LAEAKVLANRELDKY-GKSDFYKSLINRAKTVEGVHSLKDEILAAC-P | SEQ ID NO: 462 |
| 116_CC | LAEAKVLANRELDKY-GCSDFYKSLINRAKTVEGVHSLKDEILAAC-P | SEQ ID NO: 463 |
| 116_KK | LAEAKVLANRELDKY-GKSDFYKSLINRAKTVEGVHSLKDEILAAK-P | SEQ ID NO: 464 |
| 117_CK | LAEAKVLANRELDKY-GCSDYYKNVINKAKTVEGVSSLKAEILAAK-P | SEQ ID NO: 465 |
| 117_KC | LAEAKVLANRELDKY-GKSDYYKNVINKAKTVEGVSSLKAEILAAC-P | SEQ ID NO: 466 |
| 117_CC | LAEAKVLANRELDKY-GCSDYYKNVINKAKTVEGVSSLKAEILAAC-P | SEQ ID NO: 467 |
| 117_KK | LAEAKVLANRELDKY-GKSDYYKNVINKAKTVEGVSSLKAEILAAK-P | SEQ ID NO: 468 |

Figure 1S

| Designation | Amino acid sequence | SEQ ID NO |
|---|---|---|
| 118 CK | LAEAKVLANRELDKY-GCSDFYKSLINRAKTVEGVDALKSHILAAK-P | SEQ ID NO: 469 |
| 118 KC | LAEAKVLANRELDKY-GKSDFYKSLINRAKTVEGVDALKSHILAAC-P | SEQ ID NO: 470 |
| 118 CC | LAEAKVLANRELDKY-GCSDFYKSLINRAKTVEGVDALKSHILAAC-P | SEQ ID NO: 471 |
| 118 KK | LAEAKVLANRELDKY-GKSDFYKSLINRAKTVEGVDALKSHILAAK-P | SEQ ID NO: 472 |
| 119 CK | LAEAKVLANRELDKY-GCSDFYKNLINKAKTVEGVSTLKHDILAAK-P | SEQ ID NO: 473 |
| 119 KC | LAEAKVLANRELDKY-GKSDFYKNLINKAKTVEGVSTLKHDILAAC-P | SEQ ID NO: 474 |
| 119 CC | LAEAKVLANRELDKY-GCSDFYKNLINKAKTVEGVSTLKHDILAAC-P | SEQ ID NO: 475 |
| 119 KK | LAEAKVLANRELDKY-GKSDFYKNLINKAKTVEGVSTLKHDILAAK-P | SEQ ID NO: 476 |
| 120 CK | LAEAKVLANRELDKY-GCSDFYKNLINRAKTVEGVSTLKHDILAAK-P | SEQ ID NO: 477 |
| 120 KC | LAEAKVLANRELDKY-GKSDFYKNLINRAKTVEGVSTLKHDILAAC-P | SEQ ID NO: 478 |
| 120 CC | LAEAKVLANRELDKY-GCSDFYKNLINRAKTVEGVSTLKHDILAAC-P | SEQ ID NO: 479 |
| 120 KK | LAEAKVLANRELDKY-GKSDFYKNLINRAKTVEGVSTLKHDILAAK-P | SEQ ID NO: 480 |
| 121 CK | LAEAKVLANRELDKY-GCSDFYKNLINRAKTVEGVQALKSEILAAK-P | SEQ ID NO: 481 |
| 121 KC | LAEAKVLANRELDKY-GKSDFYKNLINRAKTVEGVQALKSEILAAC-P | SEQ ID NO: 482 |
| 121 CC | LAEAKVLANRELDKY-GCSDFYKNLINRAKTVEGVQALKSEILAAC-P | SEQ ID NO: 483 |
| 121 KK | LAEAKVLANRELDKY-GKSDFYKNLINRAKTVEGVQALKSEILAAK-P | SEQ ID NO: 484 |
| 122 CK | LAEAKVLANRELDKY-GCSDYYKSLINKAKTVEGVDSLKVHILAAK-P | SEQ ID NO: 485 |
| 122 KC | LAEAKVLANRELDKY-GKSDYYKSLINKAKTVEGVDSLKVHILAAC-P | SEQ ID NO: 486 |
| 122 CC | LAEAKVLANRELDKY-GCSDYYKSLINKAKTVEGVDSLKVHILAAC-P | SEQ ID NO: 487 |
| 122 KK | LAEAKVLANRELDKY-GKSDYYKSLINKAKTVEGVDSLKVHILAAK-P | SEQ ID NO: 488 |
| 123 CK | LAEAKVLANRELDKY-GCSDFYKNLINRAKTVEGVQSLKTEILAAK-P | SEQ ID NO: 489 |
| 123 KC | LAEAKVLANRELDKY-GKSDFYKNLINRAKTVEGVQSLKTEILAAC-P | SEQ ID NO: 490 |
| 123 CC | LAEAKVLANRELDKY-GCSDFYKNLINRAKTVEGVQSLKTEILAAC-P | SEQ ID NO: 491 |
| 123 KK | LAEAKVLANRELDKY-GKSDFYKNLINRAKTVEGVQSLKTEILAAK-P | SEQ ID NO: 492 |
| 124 CK | LAEAKVLANRELDKY-GCSDYYKNLINRAKTVEGVDALKTHILAAK-P | SEQ ID NO: 493 |
| 124 KC | LAEAKVLANRELDKY-GKSDYYKNLINRAKTVEGVDALKTHILAAC-P | SEQ ID NO: 494 |

Figure 1T

| Designation | Amino acid sequence | SEQ ID NO |
|---|---|---|
| 124_CC | LAEAKVLANRELDKY-GCSDYYKNLINRAKTVEGVDALKTHILAAC-P | SEQ ID NO: 495 |
| 124_KK | LAEAKVLANRELDKY-GKSDYYKNLINRAKTVEGVDALKTHILAAK-P | SEQ ID NO: 496 |
| 125_CK | LAEAKVLANRELDKY-GCSDFYKSMINRAKTVEGVDSLKTHILAAK-P | SEQ ID NO: 497 |
| 125_KC | LAEAKVLANRELDKY-GKSDFYKSMINRAKTVEGVDSLKTHILAAC-P | SEQ ID NO: 498 |
| 125_CC | LAEAKVLANRELDKY-GCSDFYKSMINRAKTVEGVDSLKTHILAAC-P | SEQ ID NO: 499 |
| 125_KK | LAEAKVLANRELDKY-GKSDFYKSMINRAKTVEGVDSLKTHILAAK-P | SEQ ID NO: 500 |
| 126_CK | LAEAKVLANRELDKY-GCSDFYKNLINRAKTVEGVTTLKTDILAAK-P | SEQ ID NO: 501 |
| 126_KC | LAEAKVLANRELDKY-GKSDFYKNLINRAKTVEGVTTLKTDILAAC-P | SEQ ID NO: 502 |
| 126_CC | LAEAKVLANRELDKY-GCSDFYKNLINRAKTVEGVTTLKTDILAAC-P | SEQ ID NO: 503 |
| 126_KK | LAEAKVLANRELDKY-GKSDFYKNLINRAKTVEGVTTLKTDILAAK-P | SEQ ID NO: 504 |
| 127_CK | LAEAKVLANRELDKY-GCSDFYKNLINRAKTVEGVESLKDHILAAK-P | SEQ ID NO: 505 |
| 127_KC | LAEAKVLANRELDKY-GKSDFYKNLINRAKTVEGVESLKDHILAAC-P | SEQ ID NO: 506 |
| 127_CC | LAEAKVLANRELDKY-GCSDFYKNLINRAKTVEGVESLKDHILAAC-P | SEQ ID NO: 507 |
| 127_KK | LAEAKVLANRELDKY-GKSDFYKNLINRAKTVEGVESLKDHILAAK-P | SEQ ID NO: 508 |
| 128_CK | LAEAKVLANRELDKY-GCSDFYKSYINRAKTVEGVHTLKGHILAAK-P | SEQ ID NO: 509 |
| 128_KC | LAEAKVLANRELDKY-GKSDFYKSYINRAKTVEGVHTLKGHILAAC-P | SEQ ID NO: 510 |
| 128_CC | LAEAKVLANRELDKY-GCSDFYKSYINRAKTVEGVHTLKGHILAAC-P | SEQ ID NO: 511 |
| 128_KK | LAEAKVLANRELDKY-GKSDFYKSYINRAKTVEGVHTLKGHILAAK-P | SEQ ID NO: 512 |
| 129_CK | LAEAKVLANRELDKY-GCSDFYKNLINRAKTVEGVQTLKSDILAAK-P | SEQ ID NO: 513 |
| 129_KC | LAEAKVLANRELDKY-GKSDFYKNLINRAKTVEGVQTLKSDILAAC-P | SEQ ID NO: 514 |
| 129_CC | LAEAKVLANRELDKY-GCSDFYKNLINRAKTVEGVQTLKSDILAAC-P | SEQ ID NO: 515 |
| 129_KK | LAEAKVLANRELDKY-GKSDFYKNLINRAKTVEGVQTLKSDILAAK-P | SEQ ID NO: 516 |
| 130_CK | LAEAKVLANRELDKY-GCSDFYKNLINRAKTVEGVNSLKSHILAAK-P | SEQ ID NO: 517 |
| 130_KC | LAEAKVLANRELDKY-GKSDFYKNLINRAKTVEGVNSLKSHILAAC-P | SEQ ID NO: 518 |
| 130_CC | LAEAKVLANRELDKY-GCSDFYKNLINRAKTVEGVNSLKSHILAAC-P | SEQ ID NO: 519 |
| 130_KK | LAEAKVLANRELDKY-GKSDFYKNLINRAKTVEGVNSLKSHILAAK-P | SEQ ID NO: 520 |

Figure 1U

| Designation | Amino acid sequence | SEQ ID NO |
|---|---|---|
| 131 CK | LAEAKVLANRELDKY-GCSDFYKNLINRAKTVEGVNTLKHDILAAK-P | SEQ ID NO: 521 |
| 131 KC | LAEAKVLANRELDKY-GKSDFYKNLINRAKTVEGVNTLKHDILAAC-P | SEQ ID NO: 522 |
| 131 CC | LAEAKVLANRELDKY-GCSDFYKNLINRAKTVEGVNTLKHDILAAC-P | SEQ ID NO: 523 |
| 131 KK | LAEAKVLANRELDKY-GKSDFYKNLINRAKTVEGVNTLKHDILAAK-P | SEQ ID NO: 524 |
| 132 CK | LAEAKVLANRELDKY-GCSDFYKNLINRAKTVEGVESLKGEILAAK-P | SEQ ID NO: 525 |
| 132 KC | LAEAKVLANRELDKY-GKSDFYKNLINRAKTVEGVESLKGEILAAC-P | SEQ ID NO: 526 |
| 132 CC | LAEAKVLANRELDKY-GCSDFYKNLINRAKTVEGVESLKGEILAAC-P | SEQ ID NO: 527 |
| 132 KK | LAEAKVLANRELDKY-GKSDFYKNLINRAKTVEGVESLKGEILAAK-P | SEQ ID NO: 528 |
| 133 CK | LAEAKVLANRELDKY-GCSDFYKNLINKAKTVEGVHTLKHDILAAK-P | SEQ ID NO: 529 |
| 133 KC | LAEAKVLANRELDKY-GKSDFYKNLINKAKTVEGVHTLKHDILAAC-P | SEQ ID NO: 530 |
| 133 CC | LAEAKVLANRELDKY-GCSDFYKNLINKAKTVEGVHTLKHDILAAC-P | SEQ ID NO: 531 |
| 133 KK | LAEAKVLANRELDKY-GKSDFYKNLINKAKTVEGVHTLKHDILAAK-P | SEQ ID NO: 532 |
| 134 CK | LAEAKVLANRELDKY-GCSDFYKNLINKAKTVEGVDALKVHILAAK-P | SEQ ID NO: 533 |
| 134 KC | LAEAKVLANRELDKY-GKSDFYKNLINKAKTVEGVDALKVHILAAC-P | SEQ ID NO: 534 |
| 134 CC | LAEAKVLANRELDKY-GCSDFYKNLINKAKTVEGVDALKVHILAAC-P | SEQ ID NO: 535 |
| 134 KK | LAEAKVLANRELDKY-GKSDFYKNLINKAKTVEGVDALKVHILAAK-P | SEQ ID NO: 536 |
| 135 CK | LAEAKVLANRELDKY-GCSDYYKRLINRAKTVEGVHALKAEILAAK-P | SEQ ID NO: 537 |
| 135 KC | LAEAKVLANRELDKY-GKSDYYKRLINRAKTVEGVHALKAEILAAC-P | SEQ ID NO: 538 |
| 135 CC | LAEAKVLANRELDKY-GCSDYYKRLINRAKTVEGVHALKAEILAAC-P | SEQ ID NO: 539 |
| 135 KK | LAEAKVLANRELDKY-GKSDYYKRLINRAKTVEGVHALKAEILAAK-P | SEQ ID NO: 540 |
| 136 CK | LAEAKVLANRELDKY-GCSDYYKNLINRARTVEGVDTLKHDILAAK-P | SEQ ID NO: 541 |
| 136 KC | LAEAKVLANRELDKY-GKSDYYKNLINRARTVEGVDTLKHDILAAC-P | SEQ ID NO: 542 |
| 136 CC | LAEAKVLANRELDKY-GCSDYYKNLINRARTVEGVDTLKHDILAAC-P | SEQ ID NO: 543 |
| 136 KK | LAEAKVLANRELDKY-GKSDYYKNLINRARTVEGVDTLKHDILAAK-P | SEQ ID NO: 544 |
| 137 CK | LAEAKVLANRELDKY-GCSDFYKKVINRARTVEGVQALKADILAAK-P | SEQ ID NO: 545 |
| 137 KC | LAEAKVLANRELDKY-GKSDFYKKVINRARTVEGVQALKADILAAC-P | SEQ ID NO: 546 |

Figure 1V

| Designation | Amino acid sequence | SEQ ID NO |
|---|---|---|
| 137_CC | LAEAKVLANRELDKY-GCSDFYKKVINRARTVEGVQALKADILAAC-P | SEQ ID NO: 547 |
| 137_KK | LAEAKVLANRELDKY-GKSDFYKKVINRARTVEGVQALKADILAAK-P | SEQ ID NO: 548 |
| 138_CK | LAEAKVLANRELDKY-GCSDFYKNLINRAKTVEGVESLKADILAAK-P | SEQ ID NO: 549 |
| 138_KC | LAEAKVLANRELDKY-GKSDFYKNLINRAKTVEGVESLKADILAAC-P | SEQ ID NO: 550 |
| 138_CC | LAEAKVLANRELDKY-GCSDFYKNLINRAKTVEGVESLKADILAAC-P | SEQ ID NO: 551 |
| 138_KK | LAEAKVLANRELDKY-GKSDFYKNLINRAKTVEGVESLKADILAAK-P | SEQ ID NO: 552 |
| 139_CK | LAEAKVLANRELDKY-GCSDYYKNLINKAKTVEGVDALKAHILAAK-P | SEQ ID NO: 553 |
| 139_KC | LAEAKVLANRELDKY-GKSDYYKNLINKAKTVEGVDALKAHILAAC-P | SEQ ID NO: 554 |
| 139_CC | LAEAKVLANRELDKY-GCSDYYKNLINKAKTVEGVDALKAHILAAC-P | SEQ ID NO: 555 |
| 139_KK | LAEAKVLANRELDKY-GKSDYYKNLINKAKTVEGVDALKAHILAAK-P | SEQ ID NO: 556 |
| 140_CK | LAEAKVLANRELDKY-GCSDYYKNLINRAKTVEGVESLKTHILAAK-P | SEQ ID NO: 557 |
| 140_KC | LAEAKVLANRELDKY-GKSDYYKNLINRAKTVEGVESLKTHILAAC-P | SEQ ID NO: 558 |
| 140_CC | LAEAKVLANRELDKY-GCSDYYKNLINRAKTVEGVESLKTHILAAC-P | SEQ ID NO: 559 |
| 140_KK | LAEAKVLANRELDKY-GKSDYYKNLINRAKTVEGVESLKTHILAAK-P | SEQ ID NO: 560 |
| 141_CK | LAEAKVLANRELDKY-GCSDFYKNLINRARTVEGVDSLKVEILAAK-P | SEQ ID NO: 561 |
| 141_KC | LAEAKVLANRELDKY-GKSDFYKNLINRARTVEGVDSLKVEILAAC-P | SEQ ID NO: 562 |
| 141_CC | LAEAKVLANRELDKY-GCSDFYKNLINRARTVEGVDSLKVEILAAC-P | SEQ ID NO: 563 |
| 141_KK | LAEAKVLANRELDKY-GKSDFYKNLINRARTVEGVDSLKVEILAAK-P | SEQ ID NO: 564 |
| 142_CK | LAEAKVLANRELDKY-GCSDFYKNVINRAKTVEGVSALKREILAAK-P | SEQ ID NO: 565 |
| 142_KC | LAEAKVLANRELDKY-GKSDFYKNVINRAKTVEGVSALKREILAAC-P | SEQ ID NO: 566 |
| 142_CC | LAEAKVLANRELDKY-GCSDFYKNVINRAKTVEGVSALKREILAAC-P | SEQ ID NO: 567 |
| 142_KK | LAEAKVLANRELDKY-GKSDFYKNVINRAKTVEGVSALKREILAAK-P | SEQ ID NO: 568 |
| 143_CK | LAEAKVLANRELDKY-GCSDFYKNLINRAKTVEGVNALKSDILAAK-P | SEQ ID NO: 569 |
| 143_KC | LAEAKVLANRELDKY-GKSDFYKNLINRAKTVEGVNALKSDILAAC-P | SEQ ID NO: 570 |
| 143_CC | LAEAKVLANRELDKY-GCSDFYKNLINRAKTVEGVNALKSDILAAC-P | SEQ ID NO: 571 |
| 143_KK | LAEAKVLANRELDKY-GKSDFYKNLINRAKTVEGVNALKSDILAAK-P | SEQ ID NO: 572 |

Figure 1W

| Designation | Amino acid sequence | SEQ ID NO |
|---|---|---|
| 144 CK | LAEAKVLANRELDKY-GCSDFYKNLINRAKTVEGVSALKQEILAAK-P | SEQ ID NO: 573 |
| 144 KC | LAEAKVLANRELDKY-GKSDFYKNLINRAKTVEGVSALKQEILAAC-P | SEQ ID NO: 574 |
| 144 CC | LAEAKVLANRELDKY-GCSDFYKNLINRAKTVEGVSALKQEILAAC-P | SEQ ID NO: 575 |
| 144 KK | LAEAKVLANRELDKY-GKSDFYKNLINRAKTVEGVSALKQEILAAK-P | SEQ ID NO: 576 |
| 145 CK | LAEAKVLANRELDKY-GCSDFYKNLINRAKTVEGVQSLKDHILAAK-P | SEQ ID NO: 577 |
| 145 KC | LAEAKVLANRELDKY-GKSDFYKNLINRAKTVEGVQSLKDHILAAC-P | SEQ ID NO: 578 |
| 145 CC | LAEAKVLANRELDKY-GCSDFYKNLINRAKTVEGVQSLKDHILAAC-P | SEQ ID NO: 579 |
| 145 KK | LAEAKVLANRELDKY-GKSDFYKNLINRAKTVEGVQSLKDHILAAK-P | SEQ ID NO: 580 |
| 146 CK | LAEAKVLANRELDKY-GCSDFYKNLINRAKTVEGVDALKCHILAAK-P | SEQ ID NO: 581 |
| 146 KC | LAEAKVLANRELDKY-GKSDFYKNLINRAKTVEGVDALKCHILAAC-P | SEQ ID NO: 582 |
| 146 CC | LAEAKVLANRELDKY-GCSDFYKNLINRAKTVEGVDALKCHILAAC-P | SEQ ID NO: 583 |
| 146 KK | LAEAKVLANRELDKY-GKSDFYKNLINRAKTVEGVDALKCHILAAK-P | SEQ ID NO: 584 |
| 147 CK | LAEAKVLANRELDKY-GCSDYYKRLINKAKTVEGVNALKTHILAAK-P | SEQ ID NO: 585 |
| 147 KC | LAEAKVLANRELDKY-GKSDYYKRLINKAKTVEGVNALKTHILAAC-P | SEQ ID NO: 586 |
| 147 CC | LAEAKVLANRELDKY-GCSDYYKRLINKAKTVEGVNALKTHILAAC-P | SEQ ID NO: 587 |
| 147 KK | LAEAKVLANRELDKY-GKSDYYKRLINKAKTVEGVNALKTHILAAK-P | SEQ ID NO: 588 |
| 148 CK | LAEAKVLANRELDKY-GCSDFYKNVINKAKTVEGVEALKADILAAK-P | SEQ ID NO: 589 |
| 148 KC | LAEAKVLANRELDKY-GKSDFYKNVINKAKTVEGVEALKADILAAC-P | SEQ ID NO: 590 |
| 148 CC | LAEAKVLANRELDKY-GCSDFYKNVINKAKTVEGVEALKADILAAC-P | SEQ ID NO: 591 |
| 148 KK | LAEAKVLANRELDKY-GKSDFYKNVINKAKTVEGVEALKADILAAK-P | SEQ ID NO: 592 |
| 149 CK | LAEAKVLANRELDKY-GCSDFYKNLINRAKTVEGVETLKRDILAAK-P | SEQ ID NO: 593 |
| 149 KC | LAEAKVLANRELDKY-GKSDFYKNLINRAKTVEGVETLKRDILAAC-P | SEQ ID NO: 594 |
| 149 CC | LAEAKVLANRELDKY-GCSDFYKNLINRAKTVEGVETLKRDILAAC-P | SEQ ID NO: 595 |
| 149 KK | LAEAKVLANRELDKY-GKSDFYKNLINRAKTVEGVETLKRDILAAK-P | SEQ ID NO: 596 |
| 150 CK | LAEAKVLANRELDKY-GCSDFYKNLINRARTVEGVQTLKTDILAAK-P | SEQ ID NO: 597 |
| 150 KC | LAEAKVLANRELDKY-GKSDFYKNLINRARTVEGVQTLKTDILAAC-P | SEQ ID NO: 598 |

Figure 1X

| Designation | Amino acid sequence | SEQ ID NO |
|---|---|---|
| 150 CC | LAEAKVLANRELDKY-GCSDFYKNLINRARTVEGVQTLKTDILAAC-P | SEQ ID NO: 599 |
| 150 KK | LAEAKVLANRELDKY-GKSDFYKNLINRARTVEGVQTLKTDILAAK-P | SEQ ID NO: 600 |
| 151 CK | LAEAKVLANRELDKY-GCSDFYKRLINKAKTVEGVNALKHHILAAK-P | SEQ ID NO: 601 |
| 151 KC | LAEAKVLANRELDKY-GKSDFYKRLINKAKTVEGVNALKHHILAAC-P | SEQ ID NO: 602 |
| 151 CC | LAEAKVLANRELDKY-GCSDFYKRLINKAKTVEGVNALKHHILAAC-P | SEQ ID NO: 603 |
| 151 KK | LAEAKVLANRELDKY-GKSDFYKRLINKAKTVEGVNALKHHILAAK-P | SEQ ID NO: 604 |
| 152 CK | LAEAKVLANRELDKY-GCSDYYKNLINRAKTVEGVQALKAHILAAK-P | SEQ ID NO: 605 |
| 152 KC | LAEAKVLANRELDKY-GKSDYYKNLINRAKTVEGVQALKAHILAAC-P | SEQ ID NO: 606 |
| 152 CC | LAEAKVLANRELDKY-GCSDYYKNLINRAKTVEGVQALKAHILAAC-P | SEQ ID NO: 607 |
| 152 KK | LAEAKVLANRELDKY-GKSDYYKNLINRAKTVEGVQALKAHILAAK-P | SEQ ID NO: 608 |
| 153 CK | LAEAKVLANRELDKY-GCSDFYKNVINRAKTVEGVNSLKNHILAAK-P | SEQ ID NO: 609 |
| 153 KC | LAEAKVLANRELDKY-GKSDFYKNVINRAKTVEGVNSLKNHILAAC-P | SEQ ID NO: 610 |
| 153 CC | LAEAKVLANRELDKY-GCSDFYKNVINRAKTVEGVNSLKNHILAAC-P | SEQ ID NO: 611 |
| 153 KK | LAEAKVLANRELDKY-GKSDFYKNVINRAKTVEGVNSLKNHILAAK-P | SEQ ID NO: 612 |
| 154 CK | LAEAKVLANRELDKY-GCSDFYKSLINRARTVEGVDSLKRHILAAK-P | SEQ ID NO: 613 |
| 154 KC | LAEAKVLANRELDKY-GKSDFYKSLINRARTVEGVDSLKRHILAAC-P | SEQ ID NO: 614 |
| 154 CC | LAEAKVLANRELDKY-GCSDFYKSLINRARTVEGVDSLKRHILAAC-P | SEQ ID NO: 615 |
| 154 KK | LAEAKVLANRELDKY-GKSDFYKSLINRARTVEGVDSLKRHILAAK-P | SEQ ID NO: 616 |
| 155 CK | LAEAKVLANRELDKY-GCSDYYKNLINKAKTVEGVEALKLHILAAK-P | SEQ ID NO: 617 |
| 155 KC | LAEAKVLANRELDKY-GKSDYYKNLINKAKTVEGVEALKLHILAAC-P | SEQ ID NO: 618 |
| 155 CC | LAEAKVLANRELDKY-GCSDYYKNLINKAKTVEGVEALKLHILAAC-P | SEQ ID NO: 619 |
| 155 KK | LAEAKVLANRELDKY-GKSDYYKNLINKAKTVEGVEALKLHILAAK-P | SEQ ID NO: 620 |
| 156 CK | LAEAKVLANRELDKY-GCSDFYKNLINRAKTVEGVDALKAHILAAK-P | SEQ ID NO: 621 |
| 156 KC | LAEAKVLANRELDKY-GKSDFYKNLINRAKTVEGVDALKAHILAAC-P | SEQ ID NO: 622 |
| 156 CC | LAEAKVLANRELDKY-GCSDFYKNLINRAKTVEGVDALKAHILAAC-P | SEQ ID NO: 623 |
| 156 KK | LAEAKVLANRELDKY-GKSDFYKNLINRAKTVEGVDALKAHILAAK-P | SEQ ID NO: 624 |

Figure 1Y

| Designation | Amino acid sequence | SEQ ID NO |
|---|---|---|
| 157_CK | LAEAKVLANRELDKY-GCSDYYKNLINKAKTVEGVQALKAHILAAK-P | SEQ ID NO: 625 |
| 157_KC | LAEAKVLANRELDKY-GKSDYYKNLINKAKTVEGVQALKAHILAAC-P | SEQ ID NO: 626 |
| 157_CC | LAEAKVLANRELDKY-GCSDYYKNLINKAKTVEGVQALKAHILAAC-P | SEQ ID NO: 627 |
| 157_KK | LAEAKVLANRELDKY-GKSDYYKNLINKAKTVEGVQALKAHILAAK-P | SEQ ID NO: 628 |
| 158_CK | LAEAKVLANRELDKY-GCSDFYKRLINRAKTVEGVHALKGHILAAK-P | SEQ ID NO: 629 |
| 158_KC | LAEAKVLANRELDKY-GKSDFYKRLINRAKTVEGVHALKGHILAAC-P | SEQ ID NO: 630 |
| 158_CC | LAEAKVLANRELDKY-GCSDFYKRLINRAKTVEGVHALKGHILAAC-P | SEQ ID NO: 631 |
| 158_KK | LAEAKVLANRELDKY-GKSDFYKRLINRAKTVEGVHALKGHILAAK-P | SEQ ID NO: 632 |
| 159_CK | LAEAKVLANRELDKY-GCSDFYKRVINRAKTVEGVHALKDHILAAK-P | SEQ ID NO: 633 |
| 159_KC | LAEAKVLANRELDKY-GKSDFYKRVINRAKTVEGVHALKDHILAAC-P | SEQ ID NO: 634 |
| 159_CC | LAEAKVLANRELDKY-GCSDFYKRVINRAKTVEGVHALKDHILAAC-P | SEQ ID NO: 635 |
| 159_KK | LAEAKVLANRELDKY-GKSDFYKRVINRAKTVEGVHALKDHILAAK-P | SEQ ID NO: 636 |
| 160_CK | LAEAKVLANRELDKY-GCSDFYKRVINRAKTVEGVSALKHEILAAK-P | SEQ ID NO: 637 |
| 160_KC | LAEAKVLANRELDKY-GKSDFYKRVINRAKTVEGVSALKHEILAAC-P | SEQ ID NO: 638 |
| 160_CC | LAEAKVLANRELDKY-GCSDFYKRVINRAKTVEGVSALKHEILAAC-P | SEQ ID NO: 639 |
| 160_KK | LAEAKVLANRELDKY-GKSDFYKRVINRAKTVEGVSALKHEILAAK-P | SEQ ID NO: 640 |
| 161_CK | LAEAKVLANRELDKY-GCSDYYKRLINRAKTVEGVNSLKSHILAAK-P | SEQ ID NO: 641 |
| 161_KC | LAEAKVLANRELDKY-GKSDYYKRLINRAKTVEGVNSLKSHILAAC-P | SEQ ID NO: 642 |
| 161_CC | LAEAKVLANRELDKY-GCSDYYKRLINRAKTVEGVNSLKSHILAAC-P | SEQ ID NO: 643 |
| 161_KK | LAEAKVLANRELDKY-GKSDYYKRLINRAKTVEGVNSLKSHILAAK-P | SEQ ID NO: 644 |
| 162_CK | LAEAKVLANRELDKY-GCSDFYKRVINRAKTVEGVDSLKAEILAAK-P | SEQ ID NO: 645 |
| 162_KC | LAEAKVLANRELDKY-GKSDFYKRVINRAKTVEGVDSLKAEILAAC-P | SEQ ID NO: 646 |
| 162_CC | LAEAKVLANRELDKY-GCSDFYKRVINRAKTVEGVDSLKAEILAAC-P | SEQ ID NO: 647 |
| 162_KK | LAEAKVLANRELDKY-GKSDFYKRVINRAKTVEGVDSLKAEILAAK-P | SEQ ID NO: 648 |
| 163_CK | LAEAKVLANRELDKY-GKSDFYKRLINRARTVEGVQTLKSDILAAK-P | SEQ ID NO: 649 |
| 163_KC | LAEAKVLANRELDKY-GKSDFYKRLINRARTVEGVQTLKSDILAAC-P | SEQ ID NO: 650 |

Figure 1Z

| Designation | Amino acid sequence | SEQ ID NO |
|---|---|---|
| 163_CC | LAEAKVLANRELDKY-GCSDFYKRLINRARTVEGVQTLKSDILAAC-P | SEQ ID NO: 651 |
| 163_KK | LAEAKVLANRELDKY-GKSDFYKRLINRARTVEGVQTLKSDILAAK-P | SEQ ID NO: 652 |
| 164_CK | LAEAKVLANRELDKY-GCSDFYKRFINKAKTVEGVETLKSEILAAK-P | SEQ ID NO: 653 |
| 164_KC | LAEAKVLANRELDKY-GKSDFYKRFINKAKTVEGVETLKSEILAAC-P | SEQ ID NO: 654 |
| 164_CC | LAEAKVLANRELDKY-GCSDFYKRFINKAKTVEGVETLKSEILAAC-P | SEQ ID NO: 655 |
| 164_KK | LAEAKVLANRELDKY-GKSDFYKRFINKAKTVEGVETLKSEILAAK-P | SEQ ID NO: 656 |
| 165_CK | LAEAKVLANRELDKY-GCSDFYKRLINRAKTVEGVHSLKDEILAAK-P | SEQ ID NO: 657 |
| 165_KC | LAEAKVLANRELDKY-GKSDFYKRLINRAKTVEGVHSLKDEILAAC-P | SEQ ID NO: 658 |
| 165_CC | LAEAKVLANRELDKY-GCSDFYKRLINRAKTVEGVHSLKDEILAAC-P | SEQ ID NO: 659 |
| 165_KK | LAEAKVLANRELDKY-GKSDFYKRLINRAKTVEGVHSLKDEILAAK-P | SEQ ID NO: 660 |
| 166_CK | LAEAKVLANRELDKY-GCSDYYKRVINKAKTVEGVSSLKAEILAAK-P | SEQ ID NO: 661 |
| 166_KC | LAEAKVLANRELDKY-GKSDYYKRVINKAKTVEGVSSLKAEILAAC-P | SEQ ID NO: 662 |
| 166_CC | LAEAKVLANRELDKY-GCSDYYKRVINKAKTVEGVSSLKAEILAAC-P | SEQ ID NO: 663 |
| 166_KK | LAEAKVLANRELDKY-GKSDYYKRVINKAKTVEGVSSLKAEILAAK-P | SEQ ID NO: 664 |
| 167_CK | LAEAKVLANRELDKY-GCSDFYKRLINRAKTVEGVDALKSHILAAK-P | SEQ ID NO: 665 |
| 167_KC | LAEAKVLANRELDKY-GKSDFYKRLINRAKTVEGVDALKSHILAAC-P | SEQ ID NO: 666 |
| 167_CC | LAEAKVLANRELDKY-GCSDFYKRLINRAKTVEGVDALKSHILAAC-P | SEQ ID NO: 667 |
| 167_KK | LAEAKVLANRELDKY-GKSDFYKRLINRAKTVEGVDALKSHILAAK-P | SEQ ID NO: 668 |
| 168_CK | LAEAKVLANRELDKY-GCSDFYKRLINRAKTVEGVSTLKHDILAAK-P | SEQ ID NO: 669 |
| 168_KC | LAEAKVLANRELDKY-GKSDFYKRLINKAKTVEGVSTLKHDILAAC-P | SEQ ID NO: 670 |
| 168_CC | LAEAKVLANRELDKY-GCSDFYKRLINKAKTVEGVSTLKHDILAAC-P | SEQ ID NO: 671 |
| 168_KK | LAEAKVLANRELDKY-GKSDFYKRLINKAKTVEGVSTLKHDILAAK-P | SEQ ID NO: 672 |
| 169_CK | LAEAKVLANRELDKY-GCSDFYKRLINRAKTVEGVSTLKHDILAAK-P | SEQ ID NO: 673 |
| 169_KC | LAEAKVLANRELDKY-GKSDFYKRLINRAKTVEGVSTLKHDILAAC-P | SEQ ID NO: 674 |
| 169_CC | LAEAKVLANRELDKY-GCSDFYKRLINRAKTVEGVSTLKHDILAAC-P | SEQ ID NO: 675 |
| 169_KK | LAEAKVLANRELDKY-GKSDFYKRLINRAKTVEGVSTLKHDILAAK-P | SEQ ID NO: 676 |

Figure 1AA

| Designation | Amino acid sequence | SEQ ID NO |
|---|---|---|
| 170_CK | LAEAKVLANRELDKY-GCSDFYKRLINRAKTVEGVQALKSEILAAK-P | SEQ ID NO: 677 |
| 170_KC | LAEAKVLANRELDKY-GKSDFYKRLINRAKTVEGVQALKSEILAAC-P | SEQ ID NO: 678 |
| 170_CC | LAEAKVLANRELDKY-GCSDFYKRLINRAKTVEGVQALKSEILAAC-P | SEQ ID NO: 679 |
| 170_KK | LAEAKVLANRELDKY-GKSDFYKRLINRAKTVEGVQALKSEILAAK-P | SEQ ID NO: 680 |
| 171_CK | LAEAKVLANRELDKY-GCSDYYKRLINKAKTVEGVDSLKVHILAAK-P | SEQ ID NO: 681 |
| 171_KC | LAEAKVLANRELDKY-GKSDYYKRLINKAKTVEGVDSLKVHILAAC-P | SEQ ID NO: 682 |
| 171_CC | LAEAKVLANRELDKY-GCSDYYKRLINKAKTVEGVDSLKVHILAAC-P | SEQ ID NO: 683 |
| 171_KK | LAEAKVLANRELDKY-GKSDYYKRLINKAKTVEGVDSLKVHILAAK-P | SEQ ID NO: 684 |
| 172_CK | LAEAKVLANRELDKY-GCSDFYKRLINRAKTVEGVQSLKTEILAAK-P | SEQ ID NO: 685 |
| 172_KC | LAEAKVLANRELDKY-GKSDFYKRLINRAKTVEGVQSLKTEILAAC-P | SEQ ID NO: 686 |
| 172_CC | LAEAKVLANRELDKY-GCSDFYKRLINRAKTVEGVQSLKTEILAAC-P | SEQ ID NO: 687 |
| 172_KK | LAEAKVLANRELDKY-GKSDFYKRLINRAKTVEGVQSLKTEILAAK-P | SEQ ID NO: 688 |
| 173_CK | LAEAKVLANRELDKY-GCSDYYKRLINRAKTVEGVDALKTHILAAK-P | SEQ ID NO: 689 |
| 173_KC | LAEAKVLANRELDKY-GKSDYYKRLINRAKTVEGVDALKTHILAAC-P | SEQ ID NO: 690 |
| 173_CC | LAEAKVLANRELDKY-GCSDYYKRLINRAKTVEGVDALKTHILAAC-P | SEQ ID NO: 691 |
| 173_KK | LAEAKVLANRELDKY-GKSDYYKRLINRAKTVEGVDALKTHILAAK-P | SEQ ID NO: 692 |
| 174_CK | LAEAKVLANRELDKY-GCSDFYKRMINRAKTVEGVDSLKTHILAAK-P | SEQ ID NO: 693 |
| 174_KC | LAEAKVLANRELDKY-GKSDFYKRMINRAKTVEGVDSLKTHILAAC-P | SEQ ID NO: 694 |
| 174_CC | LAEAKVLANRELDKY-GCSDFYKRMINRAKTVEGVDSLKTHILAAC-P | SEQ ID NO: 695 |
| 174_KK | LAEAKVLANRELDKY-GKSDFYKRMINRAKTVEGVDSLKTHILAAK-P | SEQ ID NO: 696 |
| 175_CK | LAEAKVLANRELDKY-GCSDFYKRLINRAKTVEGVTTLKTDILAAK-P | SEQ ID NO: 697 |
| 175_KC | LAEAKVLANRELDKY-GKSDFYKRLINRAKTVEGVTTLKTDILAAC-P | SEQ ID NO: 698 |
| 175_CC | LAEAKVLANRELDKY-GCSDFYKRLINRAKTVEGVTTLKTDILAAC-P | SEQ ID NO: 699 |
| 175_KK | LAEAKVLANRELDKY-GKSDFYKRLINRAKTVEGVTTLKTDILAAK-P | SEQ ID NO: 700 |
| 176_CK | LAEAKVLANRELDKY-GCSDFYKRLINRAKTVEGVESLKDHILAAK-P | SEQ ID NO: 701 |
| 176_KC | LAEAKVLANRELDKY-GKSDFYKRLINRAKTVEGVESLKDHILAAC-P | SEQ ID NO: 702 |

Figure 1BB

| Designation | Amino acid sequence | SEQ ID NO |
|---|---|---|
| 176_CC | LAEAKVLANRELDKY-GCSDFYKRLINRAKTVEGVESLKDHILAAC-P | SEQ ID NO: 703 |
| 176_KK | LAEAKVLANRELDKY-GKSDFYKRLINRAKTVEGVESLKDHILAAK-P | SEQ ID NO: 704 |
| 177_CK | LAEAKVLANRELDKY-GCSDFYKRYINRAKTVEGVHTLKGHILAAK-P | SEQ ID NO: 705 |
| 177_KC | LAEAKVLANRELDKY-GKSDFYKRYINRAKTVEGVHTLKGHILAAC-P | SEQ ID NO: 706 |
| 177_CC | LAEAKVLANRELDKY-GCSDFYKRYINRAKTVEGVHTLKGHILAAC-P | SEQ ID NO: 707 |
| 177_KK | LAEAKVLANRELDKY-GKSDFYKRYINRAKTVEGVHTLKGHILAAK-P | SEQ ID NO: 708 |
| 178_CK | LAEAKVLANRELDKY-GCSDFYKRLINRAKTVEGVQTLKSDILAAK-P | SEQ ID NO: 709 |
| 178_KC | LAEAKVLANRELDKY-GKSDFYKRLINRAKTVEGVQTLKSDILAAC-P | SEQ ID NO: 710 |
| 178_CC | LAEAKVLANRELDKY-GCSDFYKRLINRAKTVEGVQTLKSDILAAC-P | SEQ ID NO: 711 |
| 178_KK | LAEAKVLANRELDKY-GKSDFYKRLINRAKTVEGVQTLKSDILAAK-P | SEQ ID NO: 712 |
| 179_CK | LAEAKVLANRELDKY-GCSDFYKRLINRAKTVEGVNSLKSHILAAK-P | SEQ ID NO: 713 |
| 179_KC | LAEAKVLANRELDKY-GKSDFYKRLINRAKTVEGVNSLKSHILAAC-P | SEQ ID NO: 714 |
| 179_CC | LAEAKVLANRELDKY-GCSDFYKRLINRAKTVEGVNSLKSHILAAC-P | SEQ ID NO: 715 |
| 179_KK | LAEAKVLANRELDKY-GKSDFYKRLINRAKTVEGVNSLKSHILAAK-P | SEQ ID NO: 716 |
| 180_CK | LAEAKVLANRELDKY-GCSDFYKRLINRAKTVEGVNTLKHDILAAK-P | SEQ ID NO: 717 |
| 180_KC | LAEAKVLANRELDKY-GKSDFYKRLINRAKTVEGVNTLKHDILAAC-P | SEQ ID NO: 718 |
| 180_CC | LAEAKVLANRELDKY-GCSDFYKRLINRAKTVEGVNTLKHDILAAC-P | SEQ ID NO: 719 |
| 180_KK | LAEAKVLANRELDKY-GKSDFYKRLINRAKTVEGVNTLKHDILAAK-P | SEQ ID NO: 720 |
| 181_CK | LAEAKVLANRELDKY-GCSDFYKRLINRAKTVEGVESLKGEILAAK-P | SEQ ID NO: 721 |
| 181_KC | LAEAKVLANRELDKY-GKSDFYKRLINRAKTVEGVESLKGEILAAC-P | SEQ ID NO: 722 |
| 181_CC | LAEAKVLANRELDKY-GCSDFYKRLINRAKTVEGVESLKGEILAAC-P | SEQ ID NO: 723 |
| 181_KK | LAEAKVLANRELDKY-GKSDFYKRLINRAKTVEGVESLKGEILAAK-P | SEQ ID NO: 724 |
| 182_CK | LAEAKVLANRELDKY-GCSDFYKRLINKAKTVEGVHTLKHDILAAK-P | SEQ ID NO: 725 |
| 182_KC | LAEAKVLANRELDKY-GKSDFYKRLINKAKTVEGVHTLKHDILAAC-P | SEQ ID NO: 726 |
| 182_CC | LAEAKVLANRELDKY-GCSDFYKRLINKAKTVEGVHTLKHDILAAC-P | SEQ ID NO: 727 |
| 182_KK | LAEAKVLANRELDKY-GKSDFYKRLINKAKTVEGVHTLKHDILAAK-P | SEQ ID NO: 728 |

Figure 1CC

| Designation | Amino acid sequence | SEQ ID NO |
|---|---|---|
| 183_CK | LAEAKVLANRELDKY-GCSDFYKRLINKAKTVEGVDALKVHILAAK-P | SEQ ID NO: 729 |
| 183_KC | LAEAKVLANRELDKY-GKSDFYKRLINKAKTVEGVDALKVHILAAC-P | SEQ ID NO: 730 |
| 183_CC | LAEAKVLANRELDKY-GCSDFYKRLINKAKTVEGVDALKVHILAAC-P | SEQ ID NO: 731 |
| 183_KK | LAEAKVLANRELDKY-GKSDFYKRLINKAKTVEGVDALKVHILAAK-P | SEQ ID NO: 732 |
| 184_CK | LAEAKVLANRELDKY-GCSDYYKRLINRARTVEGVDTLKHDILAAK-P | SEQ ID NO: 733 |
| 184_KC | LAEAKVLANRELDKY-GKSDYYKRLINRARTVEGVDTLKHDILAAC-P | SEQ ID NO: 734 |
| 184_CC | LAEAKVLANRELDKY-GCSDYYKRLINRARTVEGVDTLKHDILAAC-P | SEQ ID NO: 735 |
| 184_KK | LAEAKVLANRELDKY-GKSDYYKRLINRARTVEGVDTLKHDILAAK-P | SEQ ID NO: 736 |
| 185_CK | LAEAKVLANRELDKY-GCSDFYKRVINRARTVEGVQALKADILAAK-P | SEQ ID NO: 737 |
| 185_KC | LAEAKVLANRELDKY-GKSDFYKRVINRARTVEGVQALKADILAAC-P | SEQ ID NO: 738 |
| 185_CC | LAEAKVLANRELDKY-GCSDFYKRVINRARTVEGVQALKADILAAC-P | SEQ ID NO: 739 |
| 185_KK | LAEAKVLANRELDKY-GKSDFYKRVINRARTVEGVQALKADILAAK-P | SEQ ID NO: 740 |
| 186_CK | LAEAKVLANRELDKY-GCSDFYKRLINRAKTVEGVESLKADILAAK-P | SEQ ID NO: 741 |
| 186_KC | LAEAKVLANRELDKY-GKSDFYKRLINRAKTVEGVESLKADILAAC-P | SEQ ID NO: 742 |
| 186_CC | LAEAKVLANRELDKY-GCSDFYKRLINRAKTVEGVESLKADILAAC-P | SEQ ID NO: 743 |
| 186_KK | LAEAKVLANRELDKY-GKSDFYKRLINRAKTVEGVESLKADILAAK-P | SEQ ID NO: 744 |
| 187_CK | LAEAKVLANRELDKY-GCSDYYKRLINKAKTVEGVDALKAHILAAK-P | SEQ ID NO: 745 |
| 187_KC | LAEAKVLANRELDKY-GKSDYYKRLINKAKTVEGVDALKAHILAAC-P | SEQ ID NO: 746 |
| 187_CC | LAEAKVLANRELDKY-GCSDYYKRLINKAKTVEGVDALKAHILAAC-P | SEQ ID NO: 747 |
| 187_KK | LAEAKVLANRELDKY-GKSDYYKRLINKAKTVEGVDALKAHILAAK-P | SEQ ID NO: 748 |
| 188_CK | LAEAKVLANRELDKY-GCSDYYKRLINRAKTVEGVESLKTHILAAK-P | SEQ ID NO: 749 |
| 188_KC | LAEAKVLANRELDKY-GKSDYYKRLINRAKTVEGVESLKTHILAAC-P | SEQ ID NO: 750 |
| 188_CC | LAEAKVLANRELDKY-GCSDYYKRLINRAKTVEGVESLKTHILAAC-P | SEQ ID NO: 751 |
| 188_KK | LAEAKVLANRELDKY-GKSDYYKRLINRAKTVEGVESLKTHILAAK-P | SEQ ID NO: 752 |
| 189_CK | LAEAKVLANRELDKY-GCSDFYKRLINRARTVEGVDSLKVEILAAK-P | SEQ ID NO: 753 |
| 189_KC | LAEAKVLANRELDKY-GKSDFYKRLINRARTVEGVDSLKVEILAAC-P | SEQ ID NO: 754 |

Figure 1DD

| Designation | Amino acid sequence | SEQ ID NO |
|---|---|---|
| 189 CC | LAEAKVLANRELDKY-GCSDFYKRLINRARTVEGVDSLKVEILAAC-P | SEQ ID NO: 755 |
| 189 KK | LAEAKVLANRELDKY-GKSDFYKRLINRARTVEGVDSLKVEILAAK-P | SEQ ID NO: 756 |
| 190 CK | LAEAKVLANRELDKY-GCSDFYKRVINRAKTVEGVSALKREILAAK-P | SEQ ID NO: 757 |
| 190 KC | LAEAKVLANRELDKY-GKSDFYKRVINRAKTVEGVSALKREILAAC-P | SEQ ID NO: 758 |
| 190 CC | LAEAKVLANRELDKY-GCSDFYKRVINRAKTVEGVSALKREILAAC-P | SEQ ID NO: 759 |
| 190 KK | LAEAKVLANRELDKY-GKSDFYKRVINRAKTVEGVSALKREILAAK-P | SEQ ID NO: 760 |
| 191 CK | LAEAKVLANRELDKY-GCSDFYKRLINRAKTVEGVNALKSDILAAK-P | SEQ ID NO: 761 |
| 191 KC | LAEAKVLANRELDKY-GKSDFYKRLINRAKTVEGVNALKSDILAAC-P | SEQ ID NO: 762 |
| 191 CC | LAEAKVLANRELDKY-GCSDFYKRLINRAKTVEGVNALKSDILAAC-P | SEQ ID NO: 763 |
| 191 KK | LAEAKVLANRELDKY-GKSDFYKRLINRAKTVEGVNALKSDILAAK-P | SEQ ID NO: 764 |
| 192 CK | LAEAKVLANRELDKY-GCSDFYKRLINRAKTVEGVSALKQEILAAK-P | SEQ ID NO: 765 |
| 192 KC | LAEAKVLANRELDKY-GKSDFYKRLINRAKTVEGVSALKQEILAAC-P | SEQ ID NO: 766 |
| 192 CC | LAEAKVLANRELDKY-GCSDFYKRLINRAKTVEGVSALKQEILAAC-P | SEQ ID NO: 767 |
| 192 KK | LAEAKVLANRELDKY-GKSDFYKRLINRAKTVEGVSALKQEILAAK-P | SEQ ID NO: 768 |
| 193 CK | LAEAKVLANRELDKY-GCSDFYKRLINRAKTVEGVQSLKDHILAAK-P | SEQ ID NO: 769 |
| 193 KC | LAEAKVLANRELDKY-GKSDFYKRLINRAKTVEGVQSLKDHILAAC-P | SEQ ID NO: 770 |
| 193 CC | LAEAKVLANRELDKY-GCSDFYKRLINRAKTVEGVQSLKDHILAAC-P | SEQ ID NO: 771 |
| 193 KK | LAEAKVLANRELDKY-GKSDFYKRLINRAKTVEGVQSLKDHILAAK-P | SEQ ID NO: 772 |
| 194 CK | LAEAKVLANRELDKY-GCSDFYKRLINRAKTVEGVDALKCHILAAK-P | SEQ ID NO: 773 |
| 194 KC | LAEAKVLANRELDKY-GKSDFYKRLINRAKTVEGVDALKCHILAAC-P | SEQ ID NO: 774 |
| 194 CC | LAEAKVLANRELDKY-GCSDFYKRLINRAKTVEGVDALKCHILAAC-P | SEQ ID NO: 775 |
| 194 KK | LAEAKVLANRELDKY-GKSDFYKRLINRAKTVEGVDALKCHILAAK-P | SEQ ID NO: 776 |
| 195 CK | LAEAKVLANRELDKY-GCSDFYKRVINKAKTVEGVEALKADILAAK-P | SEQ ID NO: 777 |
| 195 KC | LAEAKVLANRELDKY-GKSDFYKRVINKAKTVEGVEALKADILAAC-P | SEQ ID NO: 778 |
| 195 CC | LAEAKVLANRELDKY-GCSDFYKRVINKAKTVEGVEALKADILAAC-P | SEQ ID NO: 779 |
| 195 KK | LAEAKVLANRELDKY-GKSDFYKRVINKAKTVEGVEALKADILAAK-P | SEQ ID NO: 780 |

Figure 1EE

| Designation | Amino acid sequence | SEQ ID NO |
|---|---|---|
| 196_CK | LAEAKVLANRELDKY-GCSDFYKRLINRAKTVEGVETLKRDILAAK-P | SEQ ID NO: 781 |
| 196_KC | LAEAKVLANRELDKY-GKSDFYKRLINRAKTVEGVETLKRDILAAC-P | SEQ ID NO: 782 |
| 196_CC | LAEAKVLANRELDKY-GCSDFYKRLINRAKTVEGVETLKRDILAAC-P | SEQ ID NO: 783 |
| 196_KK | LAEAKVLANRELDKY-GKSDFYKRLINRAKTVEGVETLKRDILAAK-P | SEQ ID NO: 784 |
| 197_CK | LAEAKVLANRELDKY-GCSDFYKRLINRARTVEGVQTLKTDILAAK-P | SEQ ID NO: 785 |
| 197_KC | LAEAKVLANRELDKY-GKSDFYKRLINRARTVEGVQTLKTDILAAC-P | SEQ ID NO: 786 |
| 197_CC | LAEAKVLANRELDKY-GCSDFYKRLINRARTVEGVQTLKTDILAAC-P | SEQ ID NO: 787 |
| 197_KK | LAEAKVLANRELDKY-GKSDFYKRLINRARTVEGVQTLKTDILAAK-P | SEQ ID NO: 788 |
| 198_CK | LAEAKVLANRELDKY-GCSDFYKRLINRAKTVEGVQALKAHILAAK-P | SEQ ID NO: 789 |
| 198_KC | LAEAKVLANRELDKY-GKSDFYKRLINRAKTVEGVQALKAHILAAC-P | SEQ ID NO: 790 |
| 198_CC | LAEAKVLANRELDKY-GCSDYYKRLINRAKTVEGVQALKAHILAAC-P | SEQ ID NO: 791 |
| 198_KK | LAEAKVLANRELDKY-GKSDYYKRLINRAKTVEGVQALKAHILAAK-P | SEQ ID NO: 792 |
| 199_CK | LAEAKVLANRELDKY-GCSDFYKRVINRAKTVEGVNSLKNHILAAK-P | SEQ ID NO: 793 |
| 199_KC | LAEAKVLANRELDKY-GKSDFYKRVINRAKTVEGVNSLKNHILAAC-P | SEQ ID NO: 794 |
| 199_CC | LAEAKVLANRELDKY-GCSDFYKRVINRAKTVEGVNSLKNHILAAC-P | SEQ ID NO: 795 |
| 199_KK | LAEAKVLANRELDKY-GKSDFYKRLINRAKTVEGVNSLKNHILAAK-P | SEQ ID NO: 796 |
| 200_CK | LAEAKVLANRELDKY-GCSDFYKRLINRARTVEGVDSLKRHILAAK-P | SEQ ID NO: 797 |
| 200_KC | LAEAKVLANRELDKY-GKSDFYKRLINRARTVEGVDSLKRHILAAC-P | SEQ ID NO: 798 |
| 200_CC | LAEAKVLANRELDKY-GCSDFYKRLINRARTVEGVDSLKRHILAAC-P | SEQ ID NO: 799 |
| 200_KK | LAEAKVLANRELDKY-GKSDFYKRLINRARTVEGVDSLKRHILAAK-P | SEQ ID NO: 800 |
| 201_CK | LAEAKVLANRELDKY-GCSDFYKRLINKAKTVEGVEALKLHILAAK-P | SEQ ID NO: 801 |
| 201_KC | LAEAKVLANRELDKY-GKSDYYKRLINKAKTVEGVEALKLHILAAC-P | SEQ ID NO: 802 |
| 201_CC | LAEAKVLANRELDKY-GCSDYYKRLINKAKTVEGVEALKLHILAAC-P | SEQ ID NO: 803 |
| 201_KK | LAEAKVLANRELDKY-GKSDFYKRLINKAKTVEGVEALKLHILAAK-P | SEQ ID NO: 804 |
| 202_CK | LAEAKVLANRELDKY-GCSDFYKRLINRAKTVEGVDALKAHILAAK-P | SEQ ID NO: 805 |
| 202_KC | LAEAKVLANRELDKY-GKSDFYKRLINRAKTVEGVDALKAHILAAC-P | SEQ ID NO: 806 |

Figure 1FF

| Designation | Amino acid sequence | SEQ ID NO |
|---|---|---|
| 202_CC | LAEAKVLANRELDKY-GCSDFYKRLINRAKTVEGVDALKAHILAAC-P | SEQ ID NO: 807 |
| 202_KK | LAEAKVLANRELDKY-GKSDFYKRLINRAKTVEGVDALKAHILAAK-P | SEQ ID NO: 808 |
| 203_CK | LAEAKVLANRELDKY-GCSDYYKRLINKAKTVEGVQALKAHILAAK-P | SEQ ID NO: 809 |
| 203_KC | LAEAKVLANRELDKY-GKSDYYKRLINKAKTVEGVQALKAHILAAC-P | SEQ ID NO: 810 |
| 203_CC | LAEAKVLANRELDKY-GCSDYYKRLINKAKTVEGVQALKAHILAAC-P | SEQ ID NO: 811 |
| 203_KK | LAEAKVLANRELDKY-GKSDYYKRLINKAKTVEGVQALKAHILAAK-P | SEQ ID NO: 812 |
| 204_CK | LAEAKVLANRELDKY-GCSDFYKRVINRAKTVEGVSALKHHILAAK-P | SEQ ID NO: 813 |
| 204_KC | LAEAKVLANRELDKY-GKSDFYKRVINRAKTVEGVSALKHHILAAC-P | SEQ ID NO: 814 |
| 204_CC | LAEAKVLANRELDKY-GCSDFYKRVINRAKTVEGVSALKHHILAAC-P | SEQ ID NO: 815 |
| 204_KK | LAEAKVLANRELDKY-GKSDFYKRVINRAKTVEGVSALKHHILAAK-P | SEQ ID NO: 816 |
| 205_CK | LAEAKVLANRELDKY-GCSDFYKRLINRAKTVEGVNTLKAHILAAK-P | SEQ ID NO: 817 |
| 205_KC | LAEAKVLANRELDKY-GKSDFYKRLINRAKTVEGVNTLKAHILAAC-P | SEQ ID NO: 818 |
| 205_CC | LAEAKVLANRELDKY-GCSDFYKRLINRAKTVEGVNTLKAHILAAC-P | SEQ ID NO: 819 |
| 205_KK | LAEAKVLANRELDKY-GKSDFYKRLINRAKTVEGVNTLKAHILAAK-P | SEQ ID NO: 820 |
| 206_CK | LAEAKVLANRELDKY-GCSDFYKRLINRAKTVGGVQSLKSHILAAK-P | SEQ ID NO: 821 |
| 206_KC | LAEAKVLANRELDKY-GKSDFYKRLINRAKTVGGVQSLKSHILAAC-P | SEQ ID NO: 822 |
| 206_CC | LAEAKVLANRELDKY-GCSDFYKRLINRAKTVGGVQSLKSHILAAC-P | SEQ ID NO: 823 |
| 206_KK | LAEAKVLANRELDKY-GKSDFYKRLINRAKTVGGVQSLKSHILAAK-P | SEQ ID NO: 824 |
| 207_CK | LAEAKVLANRELDKY-GCSDFYKRVINRAKTVEGVDSLKAHILAAK-P | SEQ ID NO: 825 |
| 207_KC | LAEAKVLANRELDKY-GKSDFYKRVINRAKTVEGVDSLKAHILAAC-P | SEQ ID NO: 826 |
| 207_CC | LAEAKVLANRELDKY-GCSDFYKRVINRAKTVEGVDSLKAHILAAC-P | SEQ ID NO: 827 |
| 207_KK | LAEAKVLANRELDKY-GKSDFYKRVINRAKTVEGVDSLKAHILAAK-P | SEQ ID NO: 828 |
| 208_CK | LAEAKVLANRELDKY-GCSDFYKRLINRARTVEGVQTLKSHILAAK-P | SEQ ID NO: 829 |
| 208_KC | LAEAKVLANRELDKY-GKSDFYKRLINRARTVEGVQTLKSHILAAC-P | SEQ ID NO: 830 |
| 208_CC | LAEAKVLANRELDKY-GCSDFYKRLINRARTVEGVQTLKSHILAAC-P | SEQ ID NO: 831 |
| 208_KK | LAEAKVLANRELDKY-GKSDFYKRLINRARTVEGVQTLKSHILAAK-P | SEQ ID NO: 832 |

Figure 1GG

| Designation | Amino acid sequence | SEQ ID NO |
|---|---|---|
| 209 CK | LAEAKVLANRELDKY-GCSDFYKRFINKAKTVEGVETLKSHILAAK-P | SEQ ID NO: 833 |
| 209 KC | LAEAKVLANRELDKY-GKSDFYKRFINKAKTVEGVETLKSHILAAC-P | SEQ ID NO: 834 |
| 209 CC | LAEAKVLANRELDKY-GCSDFYKRFINKAKTVEGVETLKSHILAAC-P | SEQ ID NO: 835 |
| 209 KK | LAEAKVLANRELDKY-GKSDFYKRFINKAKTVEGVETLKSHILAAK-P | SEQ ID NO: 836 |
| 210 CK | LAEAKVLANRELDKY-GCSDFYKRLINRAKTVEGVHSLKDHILAAK-P | SEQ ID NO: 837 |
| 210 KC | LAEAKVLANRELDKY-GKSDFYKRLINRAKTVEGVHSLKDHILAAC-P | SEQ ID NO: 838 |
| 210 CC | LAEAKVLANRELDKY-GCSDFYKRLINRAKTVEGVHSLKDHILAAC-P | SEQ ID NO: 839 |
| 210 KK | LAEAKVLANRELDKY-GKSDFYKRLINRAKTVEGVHSLKDHILAAK-P | SEQ ID NO: 840 |
| 211 CK | LAEAKVLANRELDKY-GCSDYYKRVINKAKTVEGVSSLKAHILAAK-P | SEQ ID NO: 841 |
| 211 KC | LAEAKVLANRELDKY-GKSDYYKRVINKAKTVEGVSSLKAHILAAC-P | SEQ ID NO: 842 |
| 211 CC | LAEAKVLANRELDKY-GCSDYYKRVINKAKTVEGVSSLKAHILAAC-P | SEQ ID NO: 843 |
| 211 KK | LAEAKVLANRELDKY-GKSDYYKRVINKAKTVEGVSSLKAHILAAK-P | SEQ ID NO: 844 |
| 212 CK | LAEAKVLANRELDKY-GCSDFYKRLINKAKTVEGVSTLKHHILAAK-P | SEQ ID NO: 845 |
| 212 KC | LAEAKVLANRELDKY-GKSDFYKRLINKAKTVEGVSTLKHHILAAC-P | SEQ ID NO: 846 |
| 212 CC | LAEAKVLANRELDKY-GCSDFYKRLINKAKTVEGVSTLKHHILAAC-P | SEQ ID NO: 847 |
| 212 KK | LAEAKVLANRELDKY-GKSDFYKRLINKAKTVEGVSTLKHHILAAK-P | SEQ ID NO: 848 |
| 213 CK | LAEAKVLANRELDKY-GCSDFYKRLINRAKTVEGVSTLKHHILAAK-P | SEQ ID NO: 849 |
| 213 KC | LAEAKVLANRELDKY-GKSDFYKRLINRAKTVEGVSTLKHHILAAC-P | SEQ ID NO: 850 |
| 213 CC | LAEAKVLANRELDKY-GCSDFYKRLINRAKTVEGVSTLKHHILAAC-P | SEQ ID NO: 851 |
| 213 KK | LAEAKVLANRELDKY-GKSDFYKRLINRAKTVEGVSTLKHHILAAK-P | SEQ ID NO: 852 |
| 214 CK | LAEAKVLANRELDKY-GCSDFYKRLINRAKTVEGVQALKSHILAAK-P | SEQ ID NO: 853 |
| 214 KC | LAEAKVLANRELDKY-GKSDFYKRLINRAKTVEGVQALKSHILAAC-P | SEQ ID NO: 854 |
| 214 CC | LAEAKVLANRELDKY-GCSDFYKRLINRAKTVEGVQALKSHILAAC-P | SEQ ID NO: 855 |
| 214 KK | LAEAKVLANRELDKY-GKSDFYKRLINRAKTVEGVQALKSHILAAK-P | SEQ ID NO: 856 |
| 215 CK | LAEAKVLANRELDKY-GCSDFYKRLINRAKTVEGVQSLKTHILAAK-P | SEQ ID NO: 857 |
| 215 KC | LAEAKVLANRELDKY-GKSDFYKRLINRAKTVEGVQSLKTHILAAC-P | SEQ ID NO: 858 |

Figure 1HH

| Designation | Amino acid sequence | SEQ ID NO |
|---|---|---|
| 215 CC | LAEAKVLANRELDKY-GCSDFYKRLINRAKTVEGVQSLKTHILAAC-P | SEQ ID NO: 859 |
| 215 KK | LAEAKVLANRELDKY-GKSDFYKRLINRAKTVEGVQSLKTHILAAK-P | SEQ ID NO: 860 |
| 216 CK | LAEAKVLANRELDKY-GCSDFYKRLINRAKTVEGVTTLKTHILAAK-P | SEQ ID NO: 861 |
| 216 KC | LAEAKVLANRELDKY-GKSDFYKRLINRAKTVEGVTTLKTHILAAC-P | SEQ ID NO: 862 |
| 216 CC | LAEAKVLANRELDKY-GCSDFYKRLINRAKTVEGVTTLKTHILAAC-P | SEQ ID NO: 863 |
| 216 KK | LAEAKVLANRELDKY-GKSDFYKRLINRAKTVEGVTTLKTHILAAK-P | SEQ ID NO: 864 |
| 217 CK | LAEAKVLANRELDKY-GCSDFYKRLINRAKTVEGVQTLKSHILAAK-P | SEQ ID NO: 865 |
| 217 KC | LAEAKVLANRELDKY-GKSDFYKRLINRAKTVEGVQTLKSHILAAC-P | SEQ ID NO: 866 |
| 217 CC | LAEAKVLANRELDKY-GCSDFYKRLINRAKTVEGVQTLKSHILAAC-P | SEQ ID NO: 867 |
| 217 KK | LAEAKVLANRELDKY-GKSDFYKRLINRAKTVEGVQTLKSHILAAK-P | SEQ ID NO: 868 |
| 218 CK | LAEAKVLANRELDKY-GCSDFYKRLINRAKTVEGVNTLKHHILAAK-P | SEQ ID NO: 869 |
| 218 KC | LAEAKVLANRELDKY-GKSDFYKRLINRAKTVEGVNTLKHHILAAC-P | SEQ ID NO: 870 |
| 218 CC | LAEAKVLANRELDKY-GCSDFYKRLINRAKTVEGVNTLKHHILAAC-P | SEQ ID NO: 871 |
| 218 KK | LAEAKVLANRELDKY-GKSDFYKRLINRAKTVEGVNTLKHHILAAK-P | SEQ ID NO: 872 |
| 219 CK | LAEAKVLANRELDKY-GCSDFYKRLINRAKTVEGVESLKGHILAAK-P | SEQ ID NO: 873 |
| 219 KC | LAEAKVLANRELDKY-GKSDFYKRLINRAKTVEGVESLKGHILAAC-P | SEQ ID NO: 874 |
| 219 CC | LAEAKVLANRELDKY-GCSDFYKRLINRAKTVEGVESLKGHILAAC-P | SEQ ID NO: 875 |
| 219 KK | LAEAKVLANRELDKY-GKSDFYKRLINRAKTVEGVESLKGHILAAK-P | SEQ ID NO: 876 |
| 220 CK | LAEAKVLANRELDKY-GCSDFYKRLINKAKTVEGVHTLKHHILAAK-P | SEQ ID NO: 877 |
| 220 KC | LAEAKVLANRELDKY-GKSDFYKRLINKAKTVEGVHTLKHHILAAC-P | SEQ ID NO: 878 |
| 220 CC | LAEAKVLANRELDKY-GCSDFYKRLINKAKTVEGVHTLKHHILAAC-P | SEQ ID NO: 879 |
| 220 KK | LAEAKVLANRELDKY-GKSDFYKRLINKAKTVEGVHTLKHHILAAK-P | SEQ ID NO: 880 |
| 221 CK | LAEAKVLANRELDKY-GCSDYYKRLINRAKTVEGVHALKAHILAAK-P | SEQ ID NO: 881 |
| 221 KC | LAEAKVLANRELDKY-GKSDYYKRLINRAKTVEGVHALKAHILAAC-P | SEQ ID NO: 882 |
| 221 CC | LAEAKVLANRELDKY-GCSDYYKRLINRAKTVEGVHALKAHILAAC-P | SEQ ID NO: 883 |
| 221 KK | LAEAKVLANRELDKY-GKSDYYKRLINRAKTVEGVHALKAHILAAK-P | SEQ ID NO: 884 |

Figure 1II

| Designation | Amino acid sequence | SEQ ID NO |
|---|---|---|
| 222_CK | LAEAKVLANRELDKY-GCSDYYKRLINRARTVEGVDTLKHHILAAK-P | SEQ ID NO: 885 |
| 222_KC | LAEAKVLANRELDKY-GKSDYYKRLINRARTVEGVDTLKHHILAAC-P | SEQ ID NO: 886 |
| 222_CC | LAEAKVLANRELDKY-GCSDYYKRLINRARTVEGVDTLKHHILAAC-P | SEQ ID NO: 887 |
| 222_KK | LAEAKVLANRELDKY-GKSDYYKRLINRARTVEGVDTLKHHILAAK-P | SEQ ID NO: 888 |
| 223_CK | LAEAKVLANRELDKY-GCSDFYKRVINRARTVEGVQALKAHILAAK-P | SEQ ID NO: 889 |
| 223_KC | LAEAKVLANRELDKY-GKSDFYKRVINRARTVEGVQALKAHILAAC-P | SEQ ID NO: 890 |
| 223_CC | LAEAKVLANRELDKY-GCSDFYKRVINRARTVEGVQALKAHILAAC-P | SEQ ID NO: 891 |
| 223_KK | LAEAKVLANRELDKY-GKSDFYKRVINRARTVEGVQALKAHILAAK-P | SEQ ID NO: 892 |
| 224_CK | LAEAKVLANRELDKY-GCSDFYKRLINRAKTVEGVESLKAHILAAK-P | SEQ ID NO: 893 |
| 224_KC | LAEAKVLANRELDKY-GKSDFYKRLINRAKTVEGVESLKAHILAAC-P | SEQ ID NO: 894 |
| 224_CC | LAEAKVLANRELDKY-GCSDFYKRLINRAKTVEGVESLKAHILAAC-P | SEQ ID NO: 895 |
| 224_KK | LAEAKVLANRELDKY-GKSDFYKRLINRAKTVEGVESLKAHILAAK-P | SEQ ID NO: 896 |
| 225_CK | LAEAKVLANRELDKY-GCSDFYKRLINRARTVEGVDSLKVHILAAK-P | SEQ ID NO: 897 |
| 225_KC | LAEAKVLANRELDKY-GKSDFYKRLINRARTVEGVDSLKVHILAAC-P | SEQ ID NO: 898 |
| 225_CC | LAEAKVLANRELDKY-GCSDFYKRLINRARTVEGVDSLKVHILAAC-P | SEQ ID NO: 899 |
| 225_KK | LAEAKVLANRELDKY-GKSDFYKRLINRARTVEGVDSLKVHILAAK-P | SEQ ID NO: 900 |
| 226_CK | LAEAKVLANRELDKY-GCSDFYKRVINRAKTVEGVSALKRHILAAK-P | SEQ ID NO: 901 |
| 226_KC | LAEAKVLANRELDKY-GKSDFYKRVINRAKTVEGVSALKRHILAAC-P | SEQ ID NO: 902 |
| 226_CC | LAEAKVLANRELDKY-GCSDFYKRVINRAKTVEGVSALKRHILAAC-P | SEQ ID NO: 903 |
| 226_KK | LAEAKVLANRELDKY-GKSDFYKRVINRAKTVEGVSALKRHILAAK-P | SEQ ID NO: 904 |
| 227_CK | LAEAKVLANRELDKY-GCSDFYKRLINRAKTVEGVNALKSHILAAK-P | SEQ ID NO: 905 |
| 227_KC | LAEAKVLANRELDKY-GKSDFYKRLINRAKTVEGVNALKSHILAAC-P | SEQ ID NO: 906 |
| 227_CC | LAEAKVLANRELDKY-GCSDFYKRLINRAKTVEGVNALKSHILAAC-P | SEQ ID NO: 907 |
| 227_KK | LAEAKVLANRELDKY-GKSDFYKRLINRAKTVEGVNALKSHILAAK-P | SEQ ID NO: 908 |
| 228_CK | LAEAKVLANRELDKY-GCSDFYKRLINRAKTVEGVSALKQHILAAK-P | SEQ ID NO: 909 |
| 228_KC | LAEAKVLANRELDKY-GKSDFYKRLINRAKTVEGVSALKQHILAAC-P | SEQ ID NO: 910 |

Figure 1JJ

| Designation | Amino acid sequence | SEQ ID NO |
|---|---|---|
| 228 CC | LAEAKVLANRELDKY-GCSDFYKRLINRAKTVEGVSALKQHILAAC-P | SEQ ID NO: 911 |
| 228 KK | LAEAKVLANRELDKY-GKSDFYKRLINRAKTVEGVSALKQHILAAK-P | SEQ ID NO: 912 |
| 229 CK | LAEAKVLANRELDKY-GCSDFYKRVINKAKTVEGVEALKAHILAAK-P | SEQ ID NO: 913 |
| 229 KC | LAEAKVLANRELDKY-GKSDFYKRVINKAKTVEGVEALKAHILAAC-P | SEQ ID NO: 914 |
| 229 CC | LAEAKVLANRELDKY-GCSDFYKRVINKAKTVEGVEALKAHILAAC-P | SEQ ID NO: 915 |
| 229 KK | LAEAKVLANRELDKY-GKSDFYKRVINKAKTVEGVEALKAHILAAK-P | SEQ ID NO: 916 |
| 230 CK | LAEAKVLANRELDKY-GCSDFYKRLINRAKTVEGVETLKRHILAAK-P | SEQ ID NO: 917 |
| 230 KC | LAEAKVLANRELDKY-GKSDFYKRLINRAKTVEGVETLKRHILAAC-P | SEQ ID NO: 918 |
| 230 CC | LAEAKVLANRELDKY-GCSDFYKRLINRAKTVEGVETLKRHILAAC-P | SEQ ID NO: 919 |
| 230 KK | LAEAKVLANRELDKY-GKSDFYKRLINRAKTVEGVETLKRHILAAK-P | SEQ ID NO: 920 |
| 231 CK | LAEAKVLANRELDKY-GCSDFYKRLINRAKTVEGVQTLKTHILAAK-P | SEQ ID NO: 921 |
| 231 KC | LAEAKVLANRELDKY-GKSDFYKRLINRARTVEGVQTLKTHILAAC-P | SEQ ID NO: 922 |
| 231 CC | LAEAKVLANRELDKY-GCSDFYKRLINRARTVEGVQTLKTHILAAC-P | SEQ ID NO: 923 |
| 231 KK | LAEAKVLANRELDKY-GKSDFYKRLINRARTVEGVQTLKTHILAAK-P | SEQ ID NO: 924 |
| 232 CK | LAEAKVLANRELDKY-GCSDFYKRLINKAKTVEGVEALKLHILAAK-P | SEQ ID NO: 925 |
| 232 KC | LAEAKVLANRELDKY-GKSDFYKRLINKAKTVEGVEALKLHILAAC-P | SEQ ID NO: 926 |
| 232 CC | LAEAKVLANRELDKY-GCSDFYKRLINKAKTVEGVEALKLHILAAC-P | SEQ ID NO: 927 |
| 232 KK | LAEAKVLANRELDKY-GKSDFYKRLINKAKTVEGVEALKLHILAAK-P | SEQ ID NO: 928 |
| 233 CK | LAEAKVLANRELDKY-GCSDYYKNLINRARTVEGVEALKLHILAAK-P | SEQ ID NO: 929 |
| 233 KC | LAEAKVLANRELDKY-GKSDYYKNLINRARTVEGVEALKLHILAAC-P | SEQ ID NO: 930 |
| 233 CC | LAEAKVLANRELDKY-GCSDYYKNLINRARTVEGVEALKLHILAAC-P | SEQ ID NO: 931 |
| 233 KK | LAEAKVLANRELDKY-GKSDYYKNLINRARTVEGVEALKLHILAAK-P | SEQ ID NO: 932 |
| 234 CK | LAEAKVLANRELDKY-GCSDYYKNIINRAKTVEGVEALKLHILAAK-P | SEQ ID NO: 933 |
| 234 KC | LAEAKVLANRELDKY-GKSDYYKNIINRAKTVEGVEALKLHILAAC-P | SEQ ID NO: 934 |
| 234 CC | LAEAKVLANRELDKY-GCSDYYKNIINRAKTVEGVEALKLHILAAC-P | SEQ ID NO: 935 |
| 234 KK | LAEAKVLANRELDKY-GKSDYYKNIINRAKTVEGVEALKLHILAAK-P | SEQ ID NO: 936 |

Figure 1KK

| Designation | Amino acid sequence | SEQ ID NO |
|---|---|---|
| 235_CK | LAEAKVLANRELDKY-GCSDFYKNLINRAKTVEGVEALKLHILAAK-P | SEQ ID NO: 937 |
| 235_KC | LAEAKVLANRELDKY-GKSDFYKNLINRAKTVEGVEALKLHILAAC-P | SEQ ID NO: 938 |
| 235_CC | LAEAKVLANRELDKY-GCSDFYKNLINRAKTVEGVEALKLHILAAC-P | SEQ ID NO: 939 |
| 235_KK | LAEAKVLANRELDKY-GKSDFYKNLINRAKTVEGVEALKLHILAAK-P | SEQ ID NO: 940 |
| 236_CK | LAEAKVLANRELDKY-GCSDFYKNVINKAKTVEGVEALKLHILAAK-P | SEQ ID NO: 941 |
| 236_KC | LAEAKVLANRELDKY-GKSDFYKNVINKAKTVEGVEALKLHILAAC-P | SEQ ID NO: 942 |
| 236_CC | LAEAKVLANRELDKY-GCSDFYKNVINKAKTVEGVEALKLHILAAC-P | SEQ ID NO: 943 |
| 236_KK | LAEAKVLANRELDKY-GKSDFYKNVINKAKTVEGVEALKLHILAAK-P | SEQ ID NO: 944 |
| 237_CK | LAEAKVLANRELDKY-GCSDYYKNLINRAKTVEGVEALKLHILAAK-P | SEQ ID NO: 945 |
| 237_KC | LAEAKVLANRELDKY-GKSDYYKNLINRAKTVEGVEALKLHILAAC-P | SEQ ID NO: 946 |
| 237_CC | LAEAKVLANRELDKY-GCSDYYKNLINRAKTVEGVEALKLHILAAC-P | SEQ ID NO: 947 |
| 237_KK | LAEAKVLANRELDKY-GKSDYYKNLINRAKTVEGVEALKLHILAAK-P | SEQ ID NO: 948 |
| 238_CK | LAEAKVLANRELDKY-GCSDYYKNLINRARTVEGVHALIDHILAAK-P | SEQ ID NO: 949 |
| 238_KC | LAEAKVLANRELDKY-GKSDYYKNLINRARTVEGVHALIDHILAAC-P | SEQ ID NO: 950 |
| 238_CC | LAEAKVLANRELDKY-GCSDYYKNLINRARTVEGVHALIDHILAAC-P | SEQ ID NO: 951 |
| 238_KK | LAEAKVLANRELDKY-GKSDYYKNLINRARTVEGVHALIDHILAAK-P | SEQ ID NO: 952 |
| 239_CK | LAEAKVLANRELDKY-GCSDYYKNLINNAKTVEGVKALIDEILAAK-P | SEQ ID NO: 953 |
| 239_KC | LAEAKVLANRELDKY-GKSDYYKNLINNAKTVEGVKALIDEILAAC-P | SEQ ID NO: 954 |
| 239_CC | LAEAKVLANRELDKY-GCSDYYKNLINNAKTVEGVKALIDEILAAC-P | SEQ ID NO: 955 |
| 239_KK | LAEAKVLANRELDKY-GKSDYYKNLINNAKTVEGVKALIDEILAAK-P | SEQ ID NO: 956 |
| 240_CK | LAEAKVLALRELDKY-GCSDFYKRLINKAKTVEGVEALKLHILAAK-P | SEQ ID NO: 957 |
| 240_KC | LAEAKVLALRELDKY-GKSDFYKRLINKAKTVEGVEALKLHILAAC-P | SEQ ID NO: 958 |
| 240_CC | LAEAKVLALRELDKY-GCSDFYKRLINKAKTVEGVEALKLHILAAC-P | SEQ ID NO: 959 |
| 240_KK | LAEAKVLALRELDKY-GKSDFYKRLINKAKTVEGVEALKLHILAAK-P | SEQ ID NO: 960 |
| 241_CK | LAEAKVLALRELDKY-GCSDYYKRLISKAKTVEGVKALISEILAAK-P | SEQ ID NO: 961 |
| 241_KC | LAEAKVLALRELDKY-GKSDYYKRLISKAKTVEGVKALISEILAAC-P | SEQ ID NO: 962 |
| 241_CC | LAEAKVLALRELDKY-GCSDYYKRLISKAKTVEGVKALISEILAAC-P | SEQ ID NO: 963 |

Figure 1LL

| Designation | Amino acid sequence | SEQ ID NO |
|---|---|---|
| 241 KK | LAEAKVLALRELDKY-GKSDYYKRLISKAKTVEGVKALISEILAAK-P | SEQ ID NO: 964 |
| 242 CK | LAEAKVLAIRELDKY-GCSDFYKRLINKAKTVEGVEALKLHILAAK-P | SEQ ID NO: 965 |
| 242 KC | LAEAKVLAIRELDKY-GKSDFYKRLINKAKTVEGVEALKLHILAAC-P | SEQ ID NO: 966 |
| 242 CC | LAEAKVLAIRELDKY-GCSDFYKRLINKAKTVEGVEALKLHILAAC-P | SEQ ID NO: 967 |
| 242 KK | LAEAKVLAIRELDKY-GKSDFYKRLINKAKTVEGVEALKLHILAAK-P | SEQ ID NO: 968 |
| 243 CK | LAEAKVLAIRELDKY-GCSDYYKRLISKAKTVEGVKALISEILAAK-P | SEQ ID NO: 969 |
| 243 KC | LAEAKVLAIRELDKY-GKSDYYKRLISKAKTVEGVKALISEILAAC-P | SEQ ID NO: 970 |
| 243 CC | LAEAKVLAIRELDKY-GCSDYYKRLISKAKTVEGVKALISEILAAC-P | SEQ ID NO: 971 |
| 243 KK | LAEAKVLAIRELDKY-GKSDYYKRLISKAKTVEGVKALISEILAAK-P | SEQ ID NO: 972 |
| 244 CK | LAEAKVLAIKELDKY-GCSDYYKRLISKAKTVEGVKALISEILAAK-P | SEQ ID NO: 973 |
| 244 KC | LAEAKVLAIKELDKY-GKSDYYKRLISKAKTVEGVKALISEILAAC-P | SEQ ID NO: 974 |
| 244 CC | LAEAKVLAIKELDKY-GCSDYYKRLISKAKTVEGVKALISEILAAC-P | SEQ ID NO: 975 |
| 244 KK | LAEAKVLAIKELDKY-GKSDYYKRLISKAKTVEGVKALISEILAAK-P | SEQ ID NO: 976 |
| 245 CK | LAEAKELANRELDKY-GCSDYYKRLISKAKTVEGVKALISEILAAK-P | SEQ ID NO: 977 |
| 245 KC | LAEAKELANRELDKY-GKSDYYKRLISKAKTVEGVKALISEILAAC-P | SEQ ID NO: 978 |
| 245 CC | LAEAKELANRELDKY-GCSDYYKRLISKAKTVEGVKALISEILAAC-P | SEQ ID NO: 979 |
| 245 KK | LAEAKELANRELDKY-GKSDYYKRLISKAKTVEGVKALISEILAAK-P | SEQ ID NO: 980 |
| 246 CK | LAEAKVDANRELDKY-GCSDYYKRLISKAKTVEGVKALISEILAAK-P | SEQ ID NO: 981 |
| 246 KC | LAEAKVDANRELDKY-GKSDYYKRLISKAKTVEGVKALISEILAAC-P | SEQ ID NO: 982 |
| 246 CC | LAEAKVDANRELDKY-GCSDYYKRLISKAKTVEGVKALISEILAAC-P | SEQ ID NO: 983 |
| 246 KK | LAEAKVDANRELDKY-GKSDYYKRLISKAKTVEGVKALISEILAAK-P | SEQ ID NO: 984 |
| 247 CK | LAEAKEDANRELDKY-GCSDYYKRLISKAKTVEGVKALISEILAAK-P | SEQ ID NO: 985 |
| 247 KC | LAEAKEDANRELDKY-GKSDYYKRLISKAKTVEGVKALISEILAAC-P | SEQ ID NO: 986 |
| 247 CC | LAEAKEDANRELDKY-GCSDYYKRLISKAKTVEGVKALISEILAAC-P | SEQ ID NO: 987 |
| 247 KK | LAEAKEDANRELDKY-GKSDYYKRLISKAKTVEGVKALISEILAAK-P | SEQ ID NO: 988 |
| 248 CK | LAEAKEDAIKELDKY-GCSDYYKRLISKAKTVEGVKALISEILAAK-P | SEQ ID NO: 989 |
| 248 KC | LAEAKEDAIKELDKY-GKSDYYKRLISKAKTVEGVKALISEILAAC-P | SEQ ID NO: 990 |
| 248 CC | LAEAKEDAIKELDKY-GCSDYYKRLISKAKTVEGVKALISEILAAC-P | SEQ ID NO: 991 |

Figure 1MM

| Designation | Amino acid sequence | SEQ ID NO |
|---|---|---|
| 248 KK | LAEAKEDAIKELDKY-GKSDYYKRLISKAKTVEGVKALISEILAAK-P | SEQ ID NO: 992 |
| 249 CK | LAEAKVLALKELDKY-GKSDYYKRLISKAKTVEGVKALISEILAAK-P | SEQ ID NO: 993 |
| 249 KC | LAEAKVLALKELDKY-GCSDYYKRLISKAKTVEGVKALISEILAAC-P | SEQ ID NO: 994 |
| 249 CC | LAEAKVLALKELDKY-GCSDYYKRLISKAKTVEGVKALISEILAAC-P | SEQ ID NO: 995 |
| 249 KK | LAEAKVLALKELDKY-GKSDYYKRLISKAKTVEGVKALISEILAAK-P | SEQ ID NO: 996 |
| 250 CK | LAEAKELAIKELDKY-GCSDYYKRLISKAKTVEGVKALISEILAAK-P | SEQ ID NO: 997 |
| 250 KC | LAEAKELAIKELDKY-GKSDYYKRLISKAKTVEGVKALISEILAAC-P | SEQ ID NO: 998 |
| 250 CC | LAEAKELAIKELDKY-GCSDYYKRLISKAKTVEGVKALISEILAAC-P | SEQ ID NO: 999 |
| 250 KK | LAEAKELAIKELDKY-GKSDYYKRLISKAKTVEGVKALISEILAAK-P | SEQ ID NO: 1000 |
| 251 CK | LAEAKVDAIKELDKY-GCSDYYKRLISKAKTVEGVKALISEILAAK-P | SEQ ID NO: 1001 |
| 251 KC | LAEAKVDAIKELDKY-GKSDYYKRLISKAKTVEGVKALISEILAAC-P | SEQ ID NO: 1002 |
| 251 CC | LAEAKVDAIKELDKY-GCSDYYKRLISKAKTVEGVKALISEILAAC-P | SEQ ID NO: 1003 |
| 251 KK | LAEAKVDAIKELDKY-GKSDYYKRLISKAKTVEGVKALISEILAAK-P | SEQ ID NO: 1004 |
| 252 CK | LASAKEAANAELDAY-GCSDFYKRLIDKAKTVEGVEALKDAILAAK-P | SEQ ID NO: 1005 |
| 252 KC | LASAKEAANAELDAY-GKSDFYKRLIDKAKTVEGVEALKDAILAAC-P | SEQ ID NO: 1006 |
| 252 CC | LASAKEAANAELDAY-GCSDFYKRLIDKAKTVEGVEALKDAILAAC-P | SEQ ID NO: 1007 |
| 252 KK | LASAKEAANAELDAY-GKSDFYKRLIDKAKTVEGVEALKDAILAAK-P | SEQ ID NO: 1008 |
| 253 CK | LASAKEAANSELDAY-GCSDFYKRLIDKAKTVEGVEALKDAILAAK-P | SEQ ID NO: 1009 |
| 253 KC | LASAKEAANSELDAY-GKSDFYKRLIDKAKTVEGVEALKDAILAAC-P | SEQ ID NO: 1010 |
| 253 CC | LASAKEAANSELDAY-GCSDFYKRLIDKAKTVEGVEALKDAILAAC-P | SEQ ID NO: 1011 |
| 253 KK | LASAKEAANSELDAY-GKSDFYKRLIDKAKTVEGVEALKDAILAAK-P | SEQ ID NO: 1012 |
| 254 CK | LASAKESANSELDAY-GCSDFYKRLIDKAKTVEGVEALKDAILAAK-P | SEQ ID NO: 1013 |
| 254 KC | LASAKESANSELDAY-GKSDFYKRLIDKAKTVEGVEALKDAILAAC-P | SEQ ID NO: 1014 |
| 254 CC | LASAKESANSELDAY-GCSDFYKRLIDKAKTVEGVEALKDAILAAC-P | SEQ ID NO: 1015 |
| 254 KK | LASAKESANSELDAY-GKSDFYKRLIDKAKTVEGVEALKDAILAAK-P | SEQ ID NO: 1016 |
| 255 CK | LASAKESANAELDAY-GCSDFYKRLIDKAKTVEGVEALKDAILAAK-P | SEQ ID NO: 1017 |
| 255 KC | LASAKESANAELDAY-GKSDFYKRLIDKAKTVEGVEALKDAILAAC-P | SEQ ID NO: 1018 |

Figure 1NN

| Designation | Amino acid sequence | SEQ ID NO |
|---|---|---|
| 255_CC | LASAKESANAELDAY-GCSDFYKRLIDKAKTVEGVEALKDAILAAC-P | SEQ ID NO: 1019 |
| 255_KK | LASAKESANAELDAY-GKSDFYKRLIDKAKTVEGVEALKDAILAAK-P | SEQ ID NO: 1020 |
| 256_CK | LASAKSAANAELDAY-GCSDFYKRLIDKAKTVEGVEALKDAILAAK-P | SEQ ID NO: 1021 |
| 256_KC | LASAKSAANAELDAY-GKSDFYKRLIDKAKTVEGVEALKDAILAAC-P | SEQ ID NO: 1022 |
| 256_CC | LASAKSAANAELDAY-GCSDFYKRLIDKAKTVEGVEALKDAILAAC-P | SEQ ID NO: 1023 |
| 256_KK | LASAKSAANAELDAY-GKSDFYKRLIDKAKTVEGVEALKDAILAAK-P | SEQ ID NO: 1024 |
| 257_CK | LASAKSAANSELDAY-GCSDFYKRLIDKAKTVEGVEALKDAILAAK-P | SEQ ID NO: 1025 |
| 257_KC | LASAKSAANSELDAY-GKSDFYKRLIDKAKTVEGVEALKDAILAAC-P | SEQ ID NO: 1026 |
| 257_CC | LASAKSAANSELDAY-GCSDFYKRLIDKAKTVEGVEALKDAILAAC-P | SEQ ID NO: 1027 |
| 257_KK | LASAKSAANSELDAY-GKSDFYKRLIDKAKTVEGVEALKDAILAAK-P | SEQ ID NO: 1028 |
| 258_CK | LASAKEAANAELDSY-GCSDFYKRLIDKAKTVEGVEALKDAILAAK-P | SEQ ID NO: 1029 |
| 258_KC | LASAKEAANAELDSY-GKSDFYKRLIDKAKTVEGVEALKDAILAAC-P | SEQ ID NO: 1030 |
| 258_CC | LASAKEAANAELDSY-GCSDFYKRLIDKAKTVEGVEALKDAILAAC-P | SEQ ID NO: 1031 |
| 258_KK | LASAKEAANAELDSY-GKSDFYKRLIDKAKTVEGVEALKDAILAAK-P | SEQ ID NO: 1032 |
| 259_CK | LASAKEAANSELDSY-GCSDFYKRLIDKAKTVEGVEALKDAILAAK-P | SEQ ID NO: 1033 |
| 259_KC | LASAKEAANSELDSY-GKSDFYKRLIDKAKTVEGVEALKDAILAAC-P | SEQ ID NO: 1034 |
| 259_CC | LASAKEAANSELDSY-GCSDFYKRLIDKAKTVEGVEALKDAILAAC-P | SEQ ID NO: 1035 |
| 259_KK | LASAKEAANSELDSY-GKSDFYKRLIDKAKTVEGVEALKDAILAAK-P | SEQ ID NO: 1036 |
| 260_CK | LASAKESANSELDSY-GCSDFYKRLIDKAKTVEGVEALKDAILAAK-P | SEQ ID NO: 1037 |
| 260_KC | LASAKESANSELDSY-GKSDFYKRLIDKAKTVEGVEALKDAILAAC-P | SEQ ID NO: 1038 |
| 260_CC | LASAKESANSELDSY-GCSDFYKRLIDKAKTVEGVEALKDAILAAC-P | SEQ ID NO: 1039 |
| 260_KK | LASAKESANSELDSY-GKSDFYKRLIDKAKTVEGVEALKDAILAAK-P | SEQ ID NO: 1040 |
| 261_CK | LASAKESANAELDSY-GCSDFYKRLIDKAKTVEGVEALKDAILAAK-P | SEQ ID NO: 1041 |
| 261_KC | LASAKESANAELDSY-GKSDFYKRLIDKAKTVEGVEALKDAILAAC-P | SEQ ID NO: 1042 |
| 261_CC | LASAKESANAELDSY-GCSDFYKRLIDKAKTVEGVEALKDAILAAC-P | SEQ ID NO: 1043 |
| 261_KK | LASAKESANAELDSY-GKSDFYKRLIDKAKTVEGVEALKDAILAAK-P | SEQ ID NO: 1044 |

Figure 100

| Designation | Amino acid sequence | SEQ ID NO |
|---|---|---|
| 262_CK | LASAKSAANAELDSY-GCSDFYKRLIDKAKTVEGVEALKDAILAAK-P | SEQ ID NO: 1045 |
| 262_KC | LASAKSAANAELDSY-GKSDFYKRLIDKAKTVEGVEALKDAILAAC-P | SEQ ID NO: 1046 |
| 262_CC | LASAKSAANAELDSY-GCSDFYKRLIDKAKTVEGVEALKDAILAAC-P | SEQ ID NO: 1047 |
| 262_KK | LASAKSAANAELDSY-GKSDFYKRLIDKAKTVEGVEALKDAILAAK-P | SEQ ID NO: 1048 |
| 263_CK | LASAKSAANSELDSY-GCSDFYKRLIDKAKTVEGVEALKDAILAAK-P | SEQ ID NO: 1049 |
| 263_KC | LASAKSAANSELDSY-GKSDFYKRLIDKAKTVEGVEALKDAILAAC-P | SEQ ID NO: 1050 |
| 263_CC | LASAKSAANSELDSY-GCSDFYKRLIDKAKTVEGVEALKDAILAAC-P | SEQ ID NO: 1051 |
| 263_KK | LASAKSAANSELDSY-GKSDFYKRLIDKAKTVEGVEALKDAILAAK-P | SEQ ID NO: 1052 |
| 264_CK | LAEAKEAANSELDSY-GCSDFYKRLIDKAKTVEGVEALKDAILAAK-P | SEQ ID NO: 1053 |
| 264_KC | LAEAKEAANSELDSY-GKSDFYKRLIDKAKTVEGVEALKDAILAAC-P | SEQ ID NO: 1054 |
| 264_CC | LAEAKEAANSELDSY-GCSDFYKRLIDKAKTVEGVEALKDAILAAC-P | SEQ ID NO: 1055 |
| 264_KK | LAEAKEAANSELDSY-GKSDFYKRLIDKAKTVEGVEALKDAILAAK-P | SEQ ID NO: 1056 |
| 265_CK | LAEAKESANSELDSY-GCSDFYKRLIDKAKTVEGVEALKDAILAAK-P | SEQ ID NO: 1057 |
| 265_KC | LAEAKESANSELDSY-GKSDFYKRLIDKAKTVEGVEALKDAILAAC-P | SEQ ID NO: 1058 |
| 265_CC | LAEAKESANSELDSY-GCSDFYKRLIDKAKTVEGVEALKDAILAAC-P | SEQ ID NO: 1059 |
| 265_KK | LAEAKESANSELDSY-GKSDFYKRLIDKAKTVEGVEALKDAILAAK-P | SEQ ID NO: 1060 |
| 266_CK | LAEAKESANAELDSY-GCSDFYKRLIDKAKTVEGVEALKDAILAAK-P | SEQ ID NO: 1061 |
| 266_KC | LAEAKESANAELDSY-GKSDFYKRLIDKAKTVEGVEALKDAILAAC-P | SEQ ID NO: 1062 |
| 266_CC | LAEAKESANAELDSY-GCSDFYKRLIDKAKTVEGVEALKDAILAAC-P | SEQ ID NO: 1063 |
| 266_KK | LAEAKESANAELDSY-GKSDFYKRLIDKAKTVEGVEALKDAILAAK-P | SEQ ID NO: 1064 |
| 267_CK | LAEAKSAANAELDSY-GCSDFYKRLIDKAKTVEGVEALKDAILAAK-P | SEQ ID NO: 1065 |
| 267_KC | LAEAKSAANAELDSY-GKSDFYKRLIDKAKTVEGVEALKDAILAAC-P | SEQ ID NO: 1066 |
| 267_CC | LAEAKSAANAELDSY-GCSDFYKRLIDKAKTVEGVEALKDAILAAC-P | SEQ ID NO: 1067 |
| 267_KK | LAEAKSAANAELDSY-GKSDFYKRLIDKAKTVEGVEALKDAILAAK-P | SEQ ID NO: 1068 |
| 268_CK | LAEAKSAANSELDSY-GCSDFYKRLIDKAKTVEGVEALKDAILAAK-P | SEQ ID NO: 1069 |
| 268_KC | LAEAKSAANSELDSY-GKSDFYKRLIDKAKTVEGVEALKDAILAAC-P | SEQ ID NO: 1070 |

Figure 1PP

| Designation | Amino acid sequence | SEQ ID NO |
|---|---|---|
| 268_CC | LAEAKSAANSELDSY-GCSDFYKRLIDKAKTVEGVEALKDAILAAC-P | SEQ ID NO: 1071 |
| 268_KK | LAEAKSAANSELDSY-GKSDFYKRLIDKAKTVEGVEALKDAILAAK-P | SEQ ID NO: 1072 |
| 269_CK | LAEAKEAANAELDAY-GCSDFYKRLIDKAKTVEGVEALKDAILAAK-P | SEQ ID NO: 1073 |
| 269_KC | LAEAKEAANAELDAY-GKSDFYKRLIDKAKTVEGVEALKDAILAAC-P | SEQ ID NO: 1074 |
| 269_CC | LAEAKEAANAELDAY-GCSDFYKRLIDKAKTVEGVEALKDAILAAC-P | SEQ ID NO: 1075 |
| 269_KK | LAEAKEAANAELDAY-GKSDFYKRLIDKAKTVEGVEALKDAILAAK-P | SEQ ID NO: 1076 |
| 270_CK | LAEAKEAANSELDAY-GCSDFYKRLIDKAKTVEGVEALKDAILAAK-P | SEQ ID NO: 1077 |
| 270_KC | LAEAKEAANSELDAY-GKSDFYKRLIDKAKTVEGVEALKDAILAAC-P | SEQ ID NO: 1078 |
| 270_CC | LAEAKEAANSELDAY-GCSDFYKRLIDKAKTVEGVEALKDAILAAC-P | SEQ ID NO: 1079 |
| 270_KK | LAEAKEAANSELDAY-GKSDFYKRLIDKAKTVEGVEALKDAILAAK-P | SEQ ID NO: 1080 |
| 271_CK | LAEAKESANSELDAY-GCSDFYKRLIDKAKTVEGVEALKDAILAAK-P | SEQ ID NO: 1081 |
| 271_KC | LAEAKESANSELDAY-GKSDFYKRLIDKAKTVEGVEALKDAILAAC-P | SEQ ID NO: 1082 |
| 271_CC | LAEAKESANSELDAY-GCSDFYKRLIDKAKTVEGVEALKDAILAAC-P | SEQ ID NO: 1083 |
| 271_KK | LAEAKESANSELDAY-GKSDFYKRLIDKAKTVEGVEALKDAILAAK-P | SEQ ID NO: 1084 |
| 272_CK | LAEAKESANAELDAY-GCSDFYKRLIDKAKTVEGVEALKDAILAAK-P | SEQ ID NO: 1085 |
| 272_KC | LAEAKESANAELDAY-GKSDFYKRLIDKAKTVEGVEALKDAILAAC-P | SEQ ID NO: 1086 |
| 272_CC | LAEAKESANAELDAY-GCSDFYKRLIDKAKTVEGVEALKDAILAAC-P | SEQ ID NO: 1087 |
| 272_KK | LAEAKESANAELDAY-GKSDFYKRLIDKAKTVEGVEALKDAILAAK-P | SEQ ID NO: 1088 |
| 273_CK | LAEAKSAANAELDAY-GCSDFYKRLIDKAKTVEGVEALKDAILAAK-P | SEQ ID NO: 1089 |
| 273_KC | LAEAKSAANAELDAY-GKSDFYKRLIDKAKTVEGVEALKDAILAAC-P | SEQ ID NO: 1090 |
| 273_CC | LAEAKSAANAELDAY-GCSDFYKRLIDKAKTVEGVEALKDAILAAC-P | SEQ ID NO: 1091 |
| 273_KK | LAEAKSAANAELDAY-GKSDFYKRLIDKAKTVEGVEALKDAILAAK-P | SEQ ID NO: 1092 |
| 274_CK | LAEAKSAANSELDAY-GCSDFYKRLIDKAKTVEGVEALKDAILAAK-P | SEQ ID NO: 1093 |
| 274_KC | LAEAKSAANSELDAY-GKSDFYKRLIDKAKTVEGVEALKDAILAAC-P | SEQ ID NO: 1094 |
| 274_CC | LAEAKSAANSELDAY-GCSDFYKRLIDKAKTVEGVEALKDAILAAC-P | SEQ ID NO: 1095 |
| 274_KK | LAEAKSAANSELDAY-GKSDFYKRLIDKAKTVEGVEALKDAILAAK-P | SEQ ID NO: 1096 |

Figure 1QQ

| Designation | Amino acid sequence | SEQ ID NO |
|---|---|---|
| 275_CK | LAQAKEAANAELDAY-GCSDFYKRLIDKAKTVEGVEALKDAILAAK-P | SEQ ID NO: 1097 |
| 275_KC | LAQAKEAANAELDAY-GKSDFYKRLIDKAKTVEGVEALKDAILAAC-P | SEQ ID NO: 1098 |
| 275_CC | LAQAKEAANAELDAY-GCSDFYKRLIDKAKTVEGVEALKDAILAAC-P | SEQ ID NO: 1099 |
| 275_KK | LAQAKEAANAELDAY-GKSDFYKRLIDKAKTVEGVEALKDAILAAK-P | SEQ ID NO: 1100 |
| 276_CK | LAQAKEAANSELDAY-GCSDFYKRLIDKAKTVEGVEALKDAILAAK-P | SEQ ID NO: 1101 |
| 276_KC | LAQAKEAANSELDAY-GKSDFYKRLIDKAKTVEGVEALKDAILAAC-P | SEQ ID NO: 1102 |
| 276_CC | LAQAKEAANSELDAY-GCSDFYKRLIDKAKTVEGVEALKDAILAAC-P | SEQ ID NO: 1103 |
| 276_KK | LAQAKEAANSELDAY-GKSDFYKRLIDKAKTVEGVEALKDAILAAK-P | SEQ ID NO: 1104 |
| 277_CK | LAQAKESANSELDAY-GCSDFYKRLIDKAKTVEGVEALKDAILAAK-P | SEQ ID NO: 1105 |
| 277_KC | LAQAKESANSELDAY-GKSDFYKRLIDKAKTVEGVEALKDAILAAC-P | SEQ ID NO: 1106 |
| 277_CC | LAQAKESANSELDAY-GCSDFYKRLIDKAKTVEGVEALKDAILAAC-P | SEQ ID NO: 1107 |
| 277_KK | LAQAKESANSELDAY-GKSDFYKRLIDKAKTVEGVEALKDAILAAK-P | SEQ ID NO: 1108 |
| 278_CK | LAQAKESANAELDAY-GCSDFYKRLIDKAKTVEGVEALKDAILAAK-P | SEQ ID NO: 1109 |
| 278_KC | LAQAKESANAELDAY-GKSDFYKRLIDKAKTVEGVEALKDAILAAC-P | SEQ ID NO: 1110 |
| 278_CC | LAQAKESANAELDAY-GCSDFYKRLIDKAKTVEGVEALKDAILAAC-P | SEQ ID NO: 1111 |
| 278_KK | LAQAKESANAELDAY-GKSDFYKRLIDKAKTVEGVEALKDAILAAK-P | SEQ ID NO: 1112 |
| 279_CK | LAQAKSAANAELDAY-GCSDFYKRLIDKAKTVEGVEALKDAILAAK-P | SEQ ID NO: 1113 |
| 279_KC | LAQAKSAANAELDAY-GKSDFYKRLIDKAKTVEGVEALKDAILAAC-P | SEQ ID NO: 1114 |
| 279_CC | LAQAKSAANAELDAY-GCSDFYKRLIDKAKTVEGVEALKDAILAAC-P | SEQ ID NO: 1115 |
| 279_KK | LAQAKSAANAELDAY-GKSDFYKRLIDKAKTVEGVEALKDAILAAK-P | SEQ ID NO: 1116 |
| 280_CK | LAQAKSAANSELDAY-GCSDFYKRLIDKAKTVEGVEALKDAILAAK-P | SEQ ID NO: 1117 |
| 280_KC | LAQAKSAANSELDAY-GKSDFYKRLIDKAKTVEGVEALKDAILAAC-P | SEQ ID NO: 1118 |
| 280_CC | LAQAKSAANSELDAY-GCSDFYKRLIDKAKTVEGVEALKDAILAAC-P | SEQ ID NO: 1119 |
| 280_KK | LAQAKSAANSELDAY-GKSDFYKRLIDKAKTVEGVEALKDAILAAK-P | SEQ ID NO: 1120 |
| 281_CK | LAQAKEAANAELDSY-GCSDFYKRLIDKAKTVEGVEALKDAILAAK-P | SEQ ID NO: 1121 |
| 281_KC | LAQAKEAANAELDSY-GKSDFYKRLIDKAKTVEGVEALKDAILAAC-P | SEQ ID NO: 1122 |

Figure 1RR

| Designation | Amino acid sequence | SEQ ID NO |
|---|---|---|
| 281_CC | LAQAKEAANAELDSY-GCSDFYKRLIDKAKTVEGVEALKDAILAAC-P | SEQ ID NO: 1123 |
| 281_KK | LAQAKEAANAELDSY-GKSDFYKRLIDKAKTVEGVEALKDAILAAK-P | SEQ ID NO: 1124 |
| 282_CK | LAQAKEAANSELDSY-GCSDFYKRLIDKAKTVEGVEALKDAILAAK-P | SEQ ID NO: 1125 |
| 282_KC | LAQAKEAANSELDSY-GKSDFYKRLIDKAKTVEGVEALKDAILAAC-P | SEQ ID NO: 1126 |
| 282_CC | LAQAKEAANSELDSY-GCSDFYKRLIDKAKTVEGVEALKDAILAAC-P | SEQ ID NO: 1127 |
| 282_KK | LAQAKEAANSELDSY-GKSDFYKRLIDKAKTVEGVEALKDAILAAK-P | SEQ ID NO: 1128 |
| 283_CK | LAQAKESANSELDSY-GCSDFYKRLIDKAKTVEGVEALKDAILAAK-P | SEQ ID NO: 1129 |
| 283_KC | LAQAKESANSELDSY-GKSDFYKRLIDKAKTVEGVEALKDAILAAC-P | SEQ ID NO: 1130 |
| 283_CC | LAQAKESANSELDSY-GCSDFYKRLIDKAKTVEGVEALKDAILAAC-P | SEQ ID NO: 1131 |
| 283_KK | LAQAKESANSELDSY-GKSDFYKRLIDKAKTVEGVEALKDAILAAK-P | SEQ ID NO: 1132 |
| 284_CK | LAQAKESANAELDSY-GCSDFYKRLIDKAKTVEGVEALKDAILAAK-P | SEQ ID NO: 1133 |
| 284_KC | LAQAKESANAELDSY-GKSDFYKRLIDKAKTVEGVEALKDAILAAC-P | SEQ ID NO: 1134 |
| 284_CC | LAQAKESANAELDSY-GCSDFYKRLIDKAKTVEGVEALKDAILAAC-P | SEQ ID NO: 1135 |
| 284_KK | LAQAKESANAELDSY-GKSDFYKRLIDKAKTVEGVEALKDAILAAK-P | SEQ ID NO: 1136 |
| 285_CK | LAQAKSAANAELDSY-GCSDFYKRLIDKAKTVEGVEALKDAILAAK-P | SEQ ID NO: 1137 |
| 285_KC | LAQAKSAANAELDSY-GKSDFYKRLIDKAKTVEGVEALKDAILAAC-P | SEQ ID NO: 1138 |
| 285_CC | LAQAKSAANAELDSY-GCSDFYKRLIDKAKTVEGVEALKDAILAAC-P | SEQ ID NO: 1139 |
| 285_KK | LAQAKSAANAELDSY-GKSDFYKRLIDKAKTVEGVEALKDAILAAK-P | SEQ ID NO: 1140 |
| 286_CK | LAQAKSAANSELDSY-GCSDFYKRLIDKAKTVEGVEALKDAILAAK-P | SEQ ID NO: 1141 |
| 286_KC | LAQAKSAANSELDSY-GKSDFYKRLIDKAKTVEGVEALKDAILAAC-P | SEQ ID NO: 1142 |
| 286_CC | LAQAKSAANSELDSY-GCSDFYKRLIDKAKTVEGVEALKDAILAAC-P | SEQ ID NO: 1143 |
| 286_KK | LAQAKSAANSELDSY-GKSDFYKRLIDKAKTVEGVEALKDAILAAK-P | SEQ ID NO: 1144 |
| 287_CK | LASAKEAANAELDCY-GCSDFYKRLIDKAKTVEGVEALKDAILAAK-P | SEQ ID NO: 1145 |
| 287_KC | LASAKEAANAELDCY-GKSDFYKRLIDKAKTVEGVEALKDAILAAC-P | SEQ ID NO: 1146 |
| 287_CC | LASAKEAANAELDCY-GCSDFYKRLIDKAKTVEGVEALKDAILAAC-P | SEQ ID NO: 1147 |
| 287_KK | LASAKEAANAELDCY-GKSDFYKRLIDKAKTVEGVEALKDAILAAK-P | SEQ ID NO: 1148 |

Figure 1SS

| Designation | Amino acid sequence | SEQ ID NO |
|---|---|---|
| 288_CK | LASAKEAANSELDCY-GCSDFYKRLIDKAKTVEGVEALKDAILAAK-P | SEQ ID NO: 1149 |
| 288_KC | LASAKEAANSELDCY-GKSDFYKRLIDKAKTVEGVEALKDAILAAC-P | SEQ ID NO: 1150 |
| 288_CC | LASAKEAANSELDCY-GCSDFYKRLIDKAKTVEGVEALKDAILAAC-P | SEQ ID NO: 1151 |
| 288_KK | LASAKEAANSELDCY-GKSDFYKRLIDKAKTVEGVEALKDAILAAK-P | SEQ ID NO: 1152 |
| 289_CK | LASAKESANSELDCY-GCSDFYKRLIDKAKTVEGVEALKDAILAAK-P | SEQ ID NO: 1153 |
| 289_KC | LASAKESANSELDCY-GKSDFYKRLIDKAKTVEGVEALKDAILAAC-P | SEQ ID NO: 1154 |
| 289_CC | LASAKESANSELDCY-GCSDFYKRLIDKAKTVEGVEALKDAILAAC-P | SEQ ID NO: 1155 |
| 289_KK | LASAKESANSELDCY-GKSDFYKRLIDKAKTVEGVEALKDAILAAK-P | SEQ ID NO: 1156 |
| 290_CK | LASAKESANAELDCY-GCSDFYKRLIDKAKTVEGVEALKDAILAAK-P | SEQ ID NO: 1157 |
| 290_KC | LASAKESANAELDCY-GKSDFYKRLIDKAKTVEGVEALKDAILAAC-P | SEQ ID NO: 1158 |
| 290_CC | LASAKESANAELDCY-GCSDFYKRLIDKAKTVEGVEALKDAILAAC-P | SEQ ID NO: 1159 |
| 290_KK | LASAKESANAELDCY-GKSDFYKRLIDKAKTVEGVEALKDAILAAK-P | SEQ ID NO: 1160 |
| 291_CK | LASAKSAANAELDCY-GCSDFYKRLIDKAKTVEGVEALKDAILAAK-P | SEQ ID NO: 1161 |
| 291_KC | LASAKSAANAELDCY-GKSDFYKRLIDKAKTVEGVEALKDAILAAC-P | SEQ ID NO: 1162 |
| 291_CC | LASAKSAANAELDCY-GCSDFYKRLIDKAKTVEGVEALKDAILAAC-P | SEQ ID NO: 1163 |
| 291_KK | LASAKSAANAELDCY-GKSDFYKRLIDKAKTVEGVEALKDAILAAK-P | SEQ ID NO: 1164 |
| 292_CK | LASAKSAANSELDCY-GCSDFYKRLIDKAKTVEGVEALKDAILAAK-P | SEQ ID NO: 1165 |
| 292_KC | LASAKSAANSELDCY-GKSDFYKRLIDKAKTVEGVEALKDAILAAC-P | SEQ ID NO: 1166 |
| 292_CC | LASAKSAANSELDCY-GCSDFYKRLIDKAKTVEGVEALKDAILAAC-P | SEQ ID NO: 1167 |
| 292_KK | LASAKSAANSELDCY-GKSDFYKRLIDKAKTVEGVEALKDAILAAK-P | SEQ ID NO: 1168 |
| 293_CK | LASAKEAANAELDKY-GCSDFYKRLIDKAKTVEGVEALKDAILAAK-P | SEQ ID NO: 1169 |
| 293_KC | LASAKEAANAELDKY-GKSDFYKRLIDKAKTVEGVEALKDAILAAC-P | SEQ ID NO: 1170 |
| 293_CC | LASAKEAANAELDKY-GCSDFYKRLIDKAKTVEGVEALKDAILAAC-P | SEQ ID NO: 1171 |
| 293_KK | LASAKEAANAELDKY-GKSDFYKRLIDKAKTVEGVEALKDAILAAK-P | SEQ ID NO: 1172 |
| 294_CK | LASAKEAANSELDKY-GCSDFYKRLIDKAKTVEGVEALKDAILAAK-P | SEQ ID NO: 1173 |
| 294_KC | LASAKEAANSELDKY-GKSDFYKRLIDKAKTVEGVEALKDAILAAC-P | SEQ ID NO: 1174 |

Figure 1TT

| Designation | Amino acid sequence | SEQ ID NO |
|---|---|---|
| 294 CC | LASAKEAANSELDKY-GCSDFYKRLIDKAKTVEGVEALKDAILAAC-P | SEQ ID NO: 1175 |
| 294 KK | LASAKEAANSELDKY-GKSDFYKRLIDKAKTVEGVEALKDAILAAK-P | SEQ ID NO: 1176 |
| 295 CK | LASAKESANSELDKY-GCSDFYKRLIDKAKTVEGVEALKDAILAAK-P | SEQ ID NO: 1177 |
| 295 KC | LASAKESANSELDKY-GKSDFYKRLIDKAKTVEGVEALKDAILAAC-P | SEQ ID NO: 1178 |
| 295 CC | LASAKESANSELDKY-GCSDFYKRLIDKAKTVEGVEALKDAILAAC-P | SEQ ID NO: 1179 |
| 295 KK | LASAKESANSELDKY-GKSDFYKRLIDKAKTVEGVEALKDAILAAK-P | SEQ ID NO: 1180 |
| 296 CK | LASAKESANAELDKY-GCSDFYKRLIDKAKTVEGVEALKDAILAAK-P | SEQ ID NO: 1181 |
| 296 KC | LASAKESANAELDKY-GKSDFYKRLIDKAKTVEGVEALKDAILAAC-P | SEQ ID NO: 1182 |
| 296 CC | LASAKESANAELDKY-GCSDFYKRLIDKAKTVEGVEALKDAILAAC-P | SEQ ID NO: 1183 |
| 296 KK | LASAKESANAELDKY-GKSDFYKRLIDKAKTVEGVEALKDAILAAK-P | SEQ ID NO: 1184 |
| 297 CK | LASAKSAANAELDKY-GCSDFYKRLIDKAKTVEGVEALKDAILAAK-P | SEQ ID NO: 1185 |
| 297 KC | LASAKSAANAELDKY-GKSDFYKRLIDKAKTVEGVEALKDAILAAC-P | SEQ ID NO: 1186 |
| 297 CC | LASAKSAANAELDKY-GCSDFYKRLIDKAKTVEGVEALKDAILAAC-P | SEQ ID NO: 1187 |
| 297 KK | LASAKSAANAELDKY-GKSDFYKRLIDKAKTVEGVEALKDAILAAK-P | SEQ ID NO: 1188 |
| 298 CK | LASAKSAANSELDKY-GCSDFYKRLIDKAKTVEGVEALKDAILAAK-P | SEQ ID NO: 1189 |
| 298 KC | LASAKSAANSELDKY-GKSDFYKRLIDKAKTVEGVEALKDAILAAC-P | SEQ ID NO: 1190 |
| 298 CC | LASAKSAANSELDKY-GCSDFYKRLIDKAKTVEGVEALKDAILAAC-P | SEQ ID NO: 1191 |
| 298 KK | LASAKSAANSELDKY-GKSDFYKRLIDKAKTVEGVEALKDAILAAK-P | SEQ ID NO: 1192 |
| 299 CK | LAEAKEAANAELDCY-GCSDFYKRLIDKAKTVEGVEALKDAILAAK-P | SEQ ID NO: 1193 |
| 299 KC | LAEAKEAANAELDCY-GKSDFYKRLIDKAKTVEGVEALKDAILAAC-P | SEQ ID NO: 1194 |
| 299 CC | LAEAKEAANAELDCY-GCSDFYKRLIDKAKTVEGVEALKDAILAAC-P | SEQ ID NO: 1195 |
| 299 KK | LAEAKEAANAELDCY-GKSDFYKRLIDKAKTVEGVEALKDAILAAK-P | SEQ ID NO: 1196 |
| 300 CK | LAEAKEAANSELDCY-GCSDFYKRLIDKAKTVEGVEALKDAILAAK-P | SEQ ID NO: 1197 |
| 300 KC | LAEAKEAANSELDCY-GKSDFYKRLIDKAKTVEGVEALKDAILAAC-P | SEQ ID NO: 1198 |
| 300 CC | LAEAKEAANSELDCY-GCSDFYKRLIDKAKTVEGVEALKDAILAAC-P | SEQ ID NO: 1199 |
| 300 KK | LAEAKEAANSELDCY-GKSDFYKRLIDKAKTVEGVEALKDAILAAK-P | SEQ ID NO: 1200 |

Figure 1UU

| Designation | Amino acid sequence | SEQ ID NO |
|---|---|---|
| 301 CK | LAEAKESANSELDCY-GCSDFYKRLIDKAKTVEGVEALKDAILAAK-P | SEQ ID NO: 1201 |
| 301 KC | LAEAKESANSELDCY-GKSDFYKRLIDKAKTVEGVEALKDAILAAC-P | SEQ ID NO: 1202 |
| 301 CC | LAEAKESANSELDCY-GCSDFYKRLIDKAKTVEGVEALKDAILAAC-P | SEQ ID NO: 1203 |
| 301 KK | LAEAKESANSELDCY-GKSDFYKRLIDKAKTVEGVEALKDAILAAK-P | SEQ ID NO: 1204 |
| 302 CK | LAEAKESANAELDCY-GCSDFYKRLIDKAKTVEGVEALKDAILAAK-P | SEQ ID NO: 1205 |
| 302 KC | LAEAKESANAELDCY-GKSDFYKRLIDKAKTVEGVEALKDAILAAC-P | SEQ ID NO: 1206 |
| 302 CC | LAEAKESANAELDCY-GCSDFYKRLIDKAKTVEGVEALKDAILAAC-P | SEQ ID NO: 1207 |
| 302 KK | LAEAKESANAELDCY-GKSDFYKRLIDKAKTVEGVEALKDAILAAK-P | SEQ ID NO: 1208 |
| 303 CK | LAEAKSAANAELDCY-GCSDFYKRLIDKAKTVEGVEALKDAILAAK-P | SEQ ID NO: 1209 |
| 303 KC | LAEAKSAANAELDCY-GKSDFYKRLIDKAKTVEGVEALKDAILAAC-P | SEQ ID NO: 1210 |
| 303 CC | LAEAKSAANAELDCY-GCSDFYKRLIDKAKTVEGVEALKDAILAAC-P | SEQ ID NO: 1211 |
| 303 KK | LAEAKSAANAELDCY-GKSDFYKRLIDKAKTVEGVEALKDAILAAK-P | SEQ ID NO: 1212 |
| 304 CK | LAEAKSAANSELDCY-GCSDFYKRLIDKAKTVEGVEALKDAILAAK-P | SEQ ID NO: 1213 |
| 304 KC | LAEAKSAANSELDCY-GKSDFYKRLIDKAKTVEGVEALKDAILAAC-P | SEQ ID NO: 1214 |
| 304 CC | LAEAKSAANSELDCY-GCSDFYKRLIDKAKTVEGVEALKDAILAAC-P | SEQ ID NO: 1215 |
| 304 KK | LAEAKSAANSELDCY-GKSDFYKRLIDKAKTVEGVEALKDAILAAK-P | SEQ ID NO: 1216 |
| 305 CK | LAEAKEAANAELDKY-GCSDFYKRLIDKAKTVEGVEALKDAILAAK-P | SEQ ID NO: 1217 |
| 305 KC | LAEAKEAANAELDKY-GKSDFYKRLIDKAKTVEGVEALKDAILAAC-P | SEQ ID NO: 1218 |
| 305 CC | LAEAKEAANAELDKY-GCSDFYKRLIDKAKTVEGVEALKDAILAAC-P | SEQ ID NO: 1219 |
| 305 KK | LAEAKEAANAELDKY-GKSDFYKRLIDKAKTVEGVEALKDAILAAK-P | SEQ ID NO: 1220 |
| 306 CK | LAEAKEAANSELDKY-GCSDFYKRLIDKAKTVEGVEALKDAILAAK-P | SEQ ID NO: 1221 |
| 306 KC | LAEAKEAANSELDKY-GKSDFYKRLIDKAKTVEGVEALKDAILAAC-P | SEQ ID NO: 1222 |
| 306 CC | LAEAKEAANSELDKY-GCSDFYKRLIDKAKTVEGVEALKDAILAAC-P | SEQ ID NO: 1223 |
| 306 KK | LAEAKEAANSELDKY-GKSDFYKRLIDKAKTVEGVEALKDAILAAK-P | SEQ ID NO: 1224 |
| 307 CK | LAEAKESANSELDKY-GCSDFYKRLIDKAKTVEGVEALKDAILAAK-P | SEQ ID NO: 1225 |
| 307 KC | LAEAKESANSELDKY-GKSDFYKRLIDKAKTVEGVEALKDAILAAC-P | SEQ ID NO: 1226 |

Figure 1VV

| Designation | Amino acid sequence | SEQ ID NO |
|---|---|---|
| 307 CC | LAEAKESANSELDKY-GCSDFYKRLIDKAKTVEGVEALKDAILAAC-P | SEQ ID NO: 1227 |
| 307 KK | LAEAKESANSELDKY-GKSDFYKRLIDKAKTVEGVEALKDAILAAK-P | SEQ ID NO: 1228 |
| 308 CK | LAEAKESANAELDKY-GCSDFYKRLIDKAKTVEGVEALKDAILAAK-P | SEQ ID NO: 1229 |
| 308 KC | LAEAKESANAELDKY-GKSDFYKRLIDKAKTVEGVEALKDAILAAC-P | SEQ ID NO: 1230 |
| 308 CC | LAEAKESANAELDKY-GCSDFYKRLIDKAKTVEGVEALKDAILAAC-P | SEQ ID NO: 1231 |
| 308 KK | LAEAKESANAELDKY-GKSDFYKRLIDKAKTVEGVEALKDAILAAK-P | SEQ ID NO: 1232 |
| 309 CK | LAEAKSAANAELDKY-GCSDFYKRLIDKAKTVEGVEALKDAILAAK-P | SEQ ID NO: 1233 |
| 309 KC | LAEAKSAANAELDKY-GKSDFYKRLIDKAKTVEGVEALKDAILAAC-P | SEQ ID NO: 1234 |
| 309 CC | LAEAKSAANAELDKY-GCSDFYKRLIDKAKTVEGVEALKDAILAAC-P | SEQ ID NO: 1235 |
| 309 KK | LAEAKSAANAELDKY-GKSDFYKRLIDKAKTVEGVEALKDAILAAK-P | SEQ ID NO: 1236 |
| 310 CK | LAEAKSAANSELDKY-GCSDFYKRLIDKAKTVEGVEALKDAILAAK-P | SEQ ID NO: 1237 |
| 310 KC | LAEAKSAANSELDKY-GKSDFYKRLIDKAKTVEGVEALKDAILAAC-P | SEQ ID NO: 1238 |
| 310 CC | LAEAKSAANSELDKY-GCSDFYKRLIDKAKTVEGVEALKDAILAAC-P | SEQ ID NO: 1239 |
| 310 KK | LAEAKSAANSELDKY-GKSDFYKRLIDKAKTVEGVEALKDAILAAK-P | SEQ ID NO: 1240 |
| 311 CK | LAQAKEAANAELDCY-GCSDFYKRLIDKAKTVEGVEALKDAILAAK-P | SEQ ID NO: 1241 |
| 311 KC | LAQAKEAANAELDCY-GKSDFYKRLIDKAKTVEGVEALKDAILAAC-P | SEQ ID NO: 1242 |
| 311 CC | LAQAKEAANAELDCY-GCSDFYKRLIDKAKTVEGVEALKDAILAAC-P | SEQ ID NO: 1243 |
| 312 CK | LAQAKEAANSELDCY-GCSDFYKRLIDKAKTVEGVEALKDAILAAK-P | SEQ ID NO: 1244 |
| 312 KC | LAQAKEAANSELDCY-GKSDFYKRLIDKAKTVEGVEALKDAILAAC-P | SEQ ID NO: 1245 |
| 312 CC | LAQAKEAANSELDCY-GCSDFYKRLIDKAKTVEGVEALKDAILAAC-P | SEQ ID NO: 1246 |
| 312 KK | LAQAKEAANSELDCY-GKSDFYKRLIDKAKTVEGVEALKDAILAAK-P | SEQ ID NO: 1247 |
| 313 CK | LAQAKESANSELDCY-GCSDFYKRLIDKAKTVEGVEALKDAILAAK-P | SEQ ID NO: 1248 |
| 313 KC | LAQAKESANSELDCY-GKSDFYKRLIDKAKTVEGVEALKDAILAAC-P | SEQ ID NO: 1249 |
| 313 CC | LAQAKESANSELDCY-GCSDFYKRLIDKAKTVEGVEALKDAILAAC-P | SEQ ID NO: 1250 |
| 313 KK | LAQAKESANSELDCY-GKSDFYKRLIDKAKTVEGVEALKDAILAAK-P | SEQ ID NO: 1251 |
| | LAQAKESANSELDCY-GCSDFYKRLIDKAKTVEGVEALKDAILAAK-P | SEQ ID NO: 1252 |

Figure 1WW

| Designation | Amino acid sequence | SEQ ID NO |
|---|---|---|
| 314_CK | LAQAKESANAELDCY-GCSDFYKRLIDKAKTVEGVEALKDAILAAK-P | SEQ ID NO: 1253 |
| 314_KC | LAQAKESANAELDKY-GCSDFYKRLIDKAKTVEGVEALKDAILAAC-P | SEQ ID NO: 1254 |
| 314_CC | LAQAKESANAELDCY-GCSDFYKRLIDKAKTVEGVEALKDAILAAC-P | SEQ ID NO: 1255 |
| 314_KK | LAQAKESANAELDKY-GKSDFYKRLIDKAKTVEGVEALKDAILAAK-P | SEQ ID NO: 1256 |
| 315_CK | LAQAKSAANAELDCY-GCSDFYKRLIDKAKTVEGVEALKDAILAAK-P | SEQ ID NO: 1257 |
| 315_KC | LAQAKSAANAELDKY-GCSDFYKRLIDKAKTVEGVEALKDAILAAC-P | SEQ ID NO: 1258 |
| 315_CC | LAQAKSAANAELDCY-GCSDFYKRLIDKAKTVEGVEALKDAILAAC-P | SEQ ID NO: 1259 |
| 315_KK | LAQAKSAANAELDKY-GKSDFYKRLIDKAKTVEGVEALKDAILAAK-P | SEQ ID NO: 1260 |
| 316_CK | LAQAKSAANSELDCY-GCSDFYKRLIDKAKTVEGVEALKDAILAAK-P | SEQ ID NO: 1261 |
| 316_KC | LAQAKSAANSELDKY-GCSDFYKRLIDKAKTVEGVEALKDAILAAC-P | SEQ ID NO: 1262 |
| 316_CC | LAQAKSAANSELDCY-GCSDFYKRLIDKAKTVEGVEALKDAILAAC-P | SEQ ID NO: 1263 |
| 316_KK | LAQAKSAANSELDKY-GKSDFYKRLIDKAKTVEGVEALKDAILAAK-P | SEQ ID NO: 1264 |
| 317_CK | LAQAKEAANAELDCY-GCSDFYKRLIDKAKTVEGVEALKDAILAAK-P | SEQ ID NO: 1265 |
| 317_KC | LAQAKEAANAELDKY-GCSDFYKRLIDKAKTVEGVEALKDAILAAC-P | SEQ ID NO: 1266 |
| 317_CC | LAQAKEAANAELDCY-GCSDFYKRLIDKAKTVEGVEALKDAILAAC-P | SEQ ID NO: 1267 |
| 317_KK | LAQAKEAANAELDKY-GKSDFYKRLIDKAKTVEGVEALKDAILAAK-P | SEQ ID NO: 1268 |
| 318_CK | LAQAKEAANSELDCY-GCSDFYKRLIDKAKTVEGVEALKDAILAAK-P | SEQ ID NO: 1269 |
| 318_KC | LAQAKEAANSELDKY-GCSDFYKRLIDKAKTVEGVEALKDAILAAC-P | SEQ ID NO: 1270 |
| 318_CC | LAQAKEAANSELDCY-GCSDFYKRLIDKAKTVEGVEALKDAILAAC-P | SEQ ID NO: 1271 |
| 318_KK | LAQAKEAANSELDKY-GKSDFYKRLIDKAKTVEGVEALKDAILAAK-P | SEQ ID NO: 1272 |
| 319_CK | LAQAKESANSELDCY-GCSDFYKRLIDKAKTVEGVEALKDAILAAK-P | SEQ ID NO: 1273 |
| 319_KC | LAQAKESANSELDKY-GCSDFYKRLIDKAKTVEGVEALKDAILAAC-P | SEQ ID NO: 1274 |
| 319_CC | LAQAKESANSELDCY-GCSDFYKRLIDKAKTVEGVEALKDAILAAC-P | SEQ ID NO: 1275 |
| 319_KK | LAQAKESANSELDKY-GKSDFYKRLIDKAKTVEGVEALKDAILAAK-P | SEQ ID NO: 1276 |
| 320_CK | LAQAKESANAELDCY-GKSDFYKRLIDKAKTVEGVEALKDAILAAK-P | SEQ ID NO: 1277 |
| 320_KC | LAQAKESANAELDKY-GKSDFYKRLIDKAKTVEGVEALKDAILAAC-P | SEQ ID NO: 1278 |

Figure 1XX

| Designation | Amino acid sequence | SEQ ID NO |
|---|---|---|
| 320_CC | LAQAKESANAELDKY-GCSDFYKRLIDKAKTVEGVEALKDAILAAC-P | SEQ ID NO: 1279 |
| 320_KK | LAQAKESANAELDKY-GKSDFYKRLIDKAKTVEGVEALKDAILAAK-P | SEQ ID NO: 1280 |
| 321_CK | LAQAKSAANAELDKY-GCSDFYKRLIDKAKTVEGVEALKDAILAAK-P | SEQ ID NO: 1281 |
| 321_KC | LAQAKSAANAELDKY-GKSDFYKRLIDKAKTVEGVEALKDAILAAC-P | SEQ ID NO: 1282 |
| 321_CC | LAQAKSAANAELDKY-GCSDFYKRLIDKAKTVEGVEALKDAILAAC-P | SEQ ID NO: 1283 |
| 321_KK | LAQAKSAANAELDKY-GKSDFYKRLIDKAKTVEGVEALKDAILAAK-P | SEQ ID NO: 1284 |
| 322_CK | LAQAKSAANSELDKY-GCSDFYKRLIDKAKTVEGVEALKDAILAAK-P | SEQ ID NO: 1285 |
| 322_KC | LAQAKSAANSELDKY-GKSDFYKRLIDKAKTVEGVEALKDAILAAC-P | SEQ ID NO: 1286 |
| 322_CC | LAQAKSAANSELDKY-GCSDFYKRLIDKAKTVEGVEALKDAILAAC-P | SEQ ID NO: 1287 |
| 322_KK | LAQAKSAANSELDKY-GKSDFYKRLIDKAKTVEGVEALKDAILAAK-P | SEQ ID NO: 1288 |
| 323_CK | LACAKEAANAELDCY-GCSDFYKRLIDKAKTVEGVEALKDAILAAK-P | SEQ ID NO: 1289 |
| 323_KC | LACAKEAANAELDCY-GKSDFYKRLIDKAKTVEGVEALKDAILAAC-P | SEQ ID NO: 1290 |
| 323_CC | LACAKEAANAELDCY-GCSDFYKRLIDKAKTVEGVEALKDAILAAC-P | SEQ ID NO: 1291 |
| 323_KK | LACAKEAANAELDCY-GKSDFYKRLIDKAKTVEGVEALKDAILAAK-P | SEQ ID NO: 1292 |
| 324_CK | LACAKEAANSELDCY-GCSDFYKRLIDKAKTVEGVEALKDAILAAK-P | SEQ ID NO: 1293 |
| 324_KC | LACAKEAANSELDCY-GKSDFYKRLIDKAKTVEGVEALKDAILAAC-P | SEQ ID NO: 1294 |
| 324_CC | LACAKEAANSELDCY-GCSDFYKRLIDKAKTVEGVEALKDAILAAC-P | SEQ ID NO: 1295 |
| 324_KK | LACAKEAANSELDCY-GKSDFYKRLIDKAKTVEGVEALKDAILAAK-P | SEQ ID NO: 1296 |
| 325_CK | LACAKESANSELDCY-GCSDFYKRLIDKAKTVEGVEALKDAILAAK-P | SEQ ID NO: 1297 |
| 325_KC | LACAKESANSELDCY-GKSDFYKRLIDKAKTVEGVEALKDAILAAC-P | SEQ ID NO: 1298 |
| 325_CC | LACAKESANSELDCY-GCSDFYKRLIDKAKTVEGVEALKDAILAAC-P | SEQ ID NO: 1299 |
| 325_KK | LACAKESANSELDCY-GKSDFYKRLIDKAKTVEGVEALKDAILAAK-P | SEQ ID NO: 1300 |
| 326_CK | LACAKESANAELDCY-GCSDFYKRLIDKAKTVEGVEALKDAILAAK-P | SEQ ID NO: 1301 |
| 326_KC | LACAKESANAELDCY-GKSDFYKRLIDKAKTVEGVEALKDAILAAC-P | SEQ ID NO: 1302 |
| 326_CC | LACAKESANAELDCY-GCSDFYKRLIDKAKTVEGVEALKDAILAAC-P | SEQ ID NO: 1303 |
| 326_KK | LACAKESANAELDCY-GKSDFYKRLIDKAKTVEGVEALKDAILAAK-P | SEQ ID NO: 1304 |

Figure 1YY

| Designation | Amino acid sequence | SEQ ID NO |
|---|---|---|
| 327_CK | LACAKSAANAELDCY-GCSDFYKRLIDKAKTVEGVEALKDAILAAK-P | SEQ ID NO: 1305 |
| 327_KC | LACAKSAANAELDCY-GKSDFYKRLIDKAKTVEGVEALKDAILAAC-P | SEQ ID NO: 1306 |
| 327_CC | LACAKSAANAELDCY-GCSDFYKRLIDKAKTVEGVEALKDAILAAC-P | SEQ ID NO: 1307 |
| 327_KK | LACAKSAANAELDKY-GKSDFYKRLIDKAKTVEGVEALKDAILAAK-P | SEQ ID NO: 1308 |
| 328_CK | LACAKSAANSELDCY-GCSDFYKRLIDKAKTVEGVEALKDAILAAK-P | SEQ ID NO: 1309 |
| 328_KC | LACAKSAANSELDCY-GKSDFYKRLIDKAKTVEGVEALKDAILAAC-P | SEQ ID NO: 1310 |
| 328_CC | LACAKSAANSELDCY-GCSDFYKRLIDKAKTVEGVEALKDAILAAC-P | SEQ ID NO: 1311 |
| 328_KK | LACAKSAANSELDKY-GKSDFYKRLIDKAKTVEGVEALKDAILAAK-P | SEQ ID NO: 1312 |
| 329_CK | LACAKEAANAELDCY-GCSDFYKRLIDKAKTVEGVEALKDAILAAK-P | SEQ ID NO: 1313 |
| 329_KC | LACAKEAANAELDKY-GKSDFYKRLIDKAKTVEGVEALKDAILAAC-P | SEQ ID NO: 1314 |
| 329_CC | LACAKEAANAELDCY-GCSDFYKRLIDKAKTVEGVEALKDAILAAC-P | SEQ ID NO: 1315 |
| 329_KK | LACAKEAANAELDKY-GKSDFYKRLIDKAKTVEGVEALKDAILAAK-P | SEQ ID NO: 1316 |
| 330_CK | LACAKEAANSELDKY-GCSDFYKRLIDKAKTVEGVEALKDAILAAK-P | SEQ ID NO: 1317 |
| 330_KC | LACAKEAANSELDKY-GKSDFYKRLIDKAKTVEGVEALKDAILAAC-P | SEQ ID NO: 1318 |
| 330_CC | LACAKEAANSELDCY-GCSDFYKRLIDKAKTVEGVEALKDAILAAC-P | SEQ ID NO: 1319 |
| 330_KK | LACAKEAANSELDKY-GKSDFYKRLIDKAKTVEGVEALKDAILAAK-P | SEQ ID NO: 1320 |
| 331_CK | LACAKESANSELDKY-GCSDFYKRLIDKAKTVEGVEALKDAILAAK-P | SEQ ID NO: 1321 |
| 331_KC | LACAKESANSELDKY-GKSDFYKRLIDKAKTVEGVEALKDAILAAC-P | SEQ ID NO: 1322 |
| 331_CC | LACAKESANSELDCY-GCSDFYKRLIDKAKTVEGVEALKDAILAAC-P | SEQ ID NO: 1323 |
| 332_CK | LACAKESANAELDKY-GCSDFYKRLIDKAKTVEGVEALKDAILAAK-P | SEQ ID NO: 1324 |
| 332_KC | LACAKESANAELDKY-GKSDFYKRLIDKAKTVEGVEALKDAILAAC-P | SEQ ID NO: 1325 |
| 332_CC | LACAKESANAELDCY-GCSDFYKRLIDKAKTVEGVEALKDAILAAC-P | SEQ ID NO: 1326 |
| 332_KK | LACAKESANAELDKY-GKSDFYKRLIDKAKTVEGVEALKDAILAAK-P | SEQ ID NO: 1327 |
| 333_CK | LACAKSAANAELDKY-GCSDFYKRLIDKAKTVEGVEALKDAILAAK-P | SEQ ID NO: 1328 |
| 333_KC | LACAKSAANAELDKY-GKSDFYKRLIDKAKTVEGVEALKDAILAAC-P | SEQ ID NO: 1329 |
| 333_CC | LACAKSAANAELDKY-GKSDFYKRLIDKAKTVEGVEALKDAILAAC-P | SEQ ID NO: 1330 |

Figure 1ZZ

| Designation | Amino acid sequence | SEQ ID NO |
|---|---|---|
| 333_CC | LACAKSAANAELDKY-GCSDFYKRLIDKAKTVEGVEALKDAILAAC-P | SEQ ID NO: 1331 |
| 333_KK | LACAKSAANAELDKY-GKSDFYKRLIDKAKTVEGVEALKDAILAAK-P | SEQ ID NO: 1332 |
| 334_CK | LACAKSAANSELDKY-GCSDFYKRLIDKAKTVEGVEALKDAILAAK-P | SEQ ID NO: 1333 |
| 334_KC | LACAKSAANSELDKY-GKSDFYKRLIDKAKTVEGVEALKDAILAAC-P | SEQ ID NO: 1334 |
| 334_CC | LACAKSAANSELDKY-GCSDFYKRLIDKAKTVEGVEALKDAILAAC-P | SEQ ID NO: 1335 |
| 334_KK | LACAKSAANSELDKY-GKSDFYKRLIDKAKTVEGVEALKDAILAAK-P | SEQ ID NO: 1336 |
| 335_CK | LACAKEAANAELDSY-GCSDFYKRLIDKAKTVEGVEALKDAILAAK-P | SEQ ID NO: 1337 |
| 335_KC | LACAKEAANAELDSY-GKSDFYKRLIDKAKTVEGVEALKDAILAAC-P | SEQ ID NO: 1338 |
| 335_CC | LACAKEAANAELDSY-GCSDFYKRLIDKAKTVEGVEALKDAILAAC-P | SEQ ID NO: 1339 |
| 335_KK | LACAKEAANAELDSY-GKSDFYKRLIDKAKTVEGVEALKDAILAAK-P | SEQ ID NO: 1340 |
| 336_CK | LACAKEAANSELDSY-GCSDFYKRLIDKAKTVEGVEALKDAILAAK-P | SEQ ID NO: 1341 |
| 336_KC | LACAKEAANSELDSY-GKSDFYKRLIDKAKTVEGVEALKDAILAAC-P | SEQ ID NO: 1342 |
| 336_CC | LACAKEAANSELDSY-GCSDFYKRLIDKAKTVEGVEALKDAILAAC-P | SEQ ID NO: 1343 |
| 336_KK | LACAKEAANSELDSY-GKSDFYKRLIDKAKTVEGVEALKDAILAAK-P | SEQ ID NO: 1344 |
| 337_CK | LACAKESANSELDSY-GCSDFYKRLIDKAKTVEGVEALKDAILAAK-P | SEQ ID NO: 1345 |
| 337_KC | LACAKESANSELDSY-GKSDFYKRLIDKAKTVEGVEALKDAILAAC-P | SEQ ID NO: 1346 |
| 337_CC | LACAKESANSELDSY-GCSDFYKRLIDKAKTVEGVEALKDAILAAC-P | SEQ ID NO: 1347 |
| 337_KK | LACAKESANSELDSY-GKSDFYKRLIDKAKTVEGVEALKDAILAAK-P | SEQ ID NO: 1348 |
| 338_CK | LACAKESANAELDSY-GCSDFYKRLIDKAKTVEGVEALKDAILAAK-P | SEQ ID NO: 1349 |
| 338_KC | LACAKESANAELDSY-GKSDFYKRLIDKAKTVEGVEALKDAILAAC-P | SEQ ID NO: 1350 |
| 338_CC | LACAKESANAELDSY-GCSDFYKRLIDKAKTVEGVEALKDAILAAC-P | SEQ ID NO: 1351 |
| 338_KK | LACAKESANAELDSY-GKSDFYKRLIDKAKTVEGVEALKDAILAAK-P | SEQ ID NO: 1352 |
| 339_CK | LACAKSAANAELDSY-GCSDFYKRLIDKAKTVEGVEALKDAILAAK-P | SEQ ID NO: 1353 |
| 339_KC | LACAKSAANAELDSY-GKSDFYKRLIDKAKTVEGVEALKDAILAAC-P | SEQ ID NO: 1354 |
| 339_CC | LACAKSAANAELDSY-GCSDFYKRLIDKAKTVEGVEALKDAILAAC-P | SEQ ID NO: 1355 |
| 339_KK | LACAKSAANAELDSY-GKSDFYKRLIDKAKTVEGVEALKDAILAAK-P | SEQ ID NO: 1356 |

Figure 1AAA

| Designation | Amino acid sequence | SEQ ID NO |
|---|---|---|
| 340_CK | LACAKSAANSELDSY-GCSDFYKRLIDKAKTVEGVEALKDAILAAK-P | SEQ ID NO: 1357 |
| 340_KC | LACAKSAANSELDSY-GKSDFYKRLIDKAKTVEGVEALKDAILAAC-P | SEQ ID NO: 1358 |
| 340_CC | LACAKSAANSELDSY-GCSDFYKRLIDKAKTVEGVEALKDAILAAC-P | SEQ ID NO: 1359 |
| 340_KK | LACAKSAANSELDSY-GKSDFYKRLIDKAKTVEGVEALKDAILAAK-P | SEQ ID NO: 1360 |
| 341_CK | LACAKEAANAELDAY-GCSDFYKRLIDKAKTVEGVEALKDAILAAK-P | SEQ ID NO: 1361 |
| 341_KC | LACAKEAANAELDAY-GKSDFYKRLIDKAKTVEGVEALKDAILAAC-P | SEQ ID NO: 1362 |
| 341_CC | LACAKEAANAELDAY-GCSDFYKRLIDKAKTVEGVEALKDAILAAC-P | SEQ ID NO: 1363 |
| 341_KK | LACAKEAANAELDAY-GKSDFYKRLIDKAKTVEGVEALKDAILAAK-P | SEQ ID NO: 1364 |
| 342_CK | LACAKSAANSELDAY-GCSDFYKRLIDKAKTVEGVEALKDAILAAK-P | SEQ ID NO: 1365 |
| 342_KC | LACAKEAANSELDAY-GKSDFYKRLIDKAKTVEGVEALKDAILAAC-P | SEQ ID NO: 1366 |
| 342_CC | LACAKEAANSELDAY-GCSDFYKRLIDKAKTVEGVEALKDAILAAC-P | SEQ ID NO: 1367 |
| 342_KK | LACAKEAANSELDAY-GKSDFYKRLIDKAKTVEGVEALKDAILAAK-P | SEQ ID NO: 1368 |
| 343_CK | LACAKESANSELDAY-GCSDFYKRLIDKAKTVEGVEALKDAILAAK-P | SEQ ID NO: 1369 |
| 343_KC | LACAKESANSELDAY-GKSDFYKRLIDKAKTVEGVEALKDAILAAC-P | SEQ ID NO: 1370 |
| 343_CC | LACAKESANSELDAY-GCSDFYKRLIDKAKTVEGVEALKDAILAAC-P | SEQ ID NO: 1371 |
| 343_KK | LACAKESANSELDAY-GKSDFYKRLIDKAKTVEGVEALKDAILAAK-P | SEQ ID NO: 1372 |
| 344_CK | LACAKESANAELDAY-GCSDFYKRLIDKAKTVEGVEALKDAILAAK-P | SEQ ID NO: 1373 |
| 344_KC | LACAKESANAELDAY-GKSDFYKRLIDKAKTVEGVEALKDAILAAC-P | SEQ ID NO: 1374 |
| 344_CC | LACAKESANAELDAY-GCSDFYKRLIDKAKTVEGVEALKDAILAAC-P | SEQ ID NO: 1375 |
| 344_KK | LACAKESANAELDAY-GKSDFYKRLIDKAKTVEGVEALKDAILAAK-P | SEQ ID NO: 1376 |
| 345_CK | LACAKSAANAELDAY-GCSDFYKRLIDKAKTVEGVEALKDAILAAK-P | SEQ ID NO: 1377 |
| 345_KC | LACAKSAANAELDAY-GKSDFYKRLIDKAKTVEGVEALKDAILAAC-P | SEQ ID NO: 1378 |
| 345_CC | LACAKSAANAELDAY-GCSDFYKRLIDKAKTVEGVEALKDAILAAC-P | SEQ ID NO: 1379 |
| 345_KK | LACAKSAANAELDAY-GKSDFYKRLIDKAKTVEGVEALKDAILAAK-P | SEQ ID NO: 1380 |
| 346_CK | LACAKSAANSELDAY-GCSDFYKRLIDKAKTVEGVEALKDAILAAK-P | SEQ ID NO: 1381 |
| 346_KC | LACAKSAANSELDAY-GKSDFYKRLIDKAKTVEGVEALKDAILAAC-P | SEQ ID NO: 1382 |

Figure 1BBB

| Designation | Amino acid sequence | SEQ ID NO |
|---|---|---|
| 346_CC | LACAKSAANSELDAY-GCSDFYKRLIDKAKTVEGVEALKDAILAAC-P | SEQ ID NO: 1383 |
| 346_KK | LACAKSAANSELDAY-GCSDFYKRLIDKAKTVEGVEALKDAILAAK-P | SEQ ID NO: 1384 |
| 347_CK | LAQAKCAANAELDAY-GCSDFYKRLIDKAKTVEGVEALKDAILAAK-P | SEQ ID NO: 1385 |
| 347_KC | LAQAKCAANAELDAY-GKSDFYKRLIDKAKTVEGVEALKDAILAAC-P | SEQ ID NO: 1386 |
| 347_CC | LAQAKCAANAELDAY-GCSDFYKRLIDKAKTVEGVEALKDAILAAC-P | SEQ ID NO: 1387 |
| 347_KK | LAQAKCAANAELDAY-GKSDFYKRLIDKAKTVEGVEALKDAILAAK-P | SEQ ID NO: 1388 |
| 348_CK | LAQAKCAANSELDAY-GCSDFYKRLIDKAKTVEGVEALKDAILAAK-P | SEQ ID NO: 1389 |
| 348_KC | LAQAKCAANSELDAY-GKSDFYKRLIDKAKTVEGVEALKDAILAAC-P | SEQ ID NO: 1390 |
| 348_CC | LAQAKCAANSELDAY-GCSDFYKRLIDKAKTVEGVEALKDAILAAC-P | SEQ ID NO: 1391 |
| 348_KK | LAQAKCAANSELDAY-GKSDFYKRLIDKAKTVEGVEALKDAILAAK-P | SEQ ID NO: 1392 |
| 349_CK | LAQAKCSANSELDAY-GCSDFYKRLIDKAKTVEGVEALKDAILAAK-P | SEQ ID NO: 1393 |
| 349_KC | LAQAKCSANSELDAY-GKSDFYKRLIDKAKTVEGVEALKDAILAAC-P | SEQ ID NO: 1394 |
| 349_CC | LAQAKCSANSELDAY-GCSDFYKRLIDKAKTVEGVEALKDAILAAC-P | SEQ ID NO: 1395 |
| 349_KK | LAQAKCSANSELDAY-GKSDFYKRLIDKAKTVEGVEALKDAILAAK-P | SEQ ID NO: 1396 |
| 350_CK | LAQAKCSANAELDAY-GCSDFYKRLIDKAKTVEGVEALKDAILAAK-P | SEQ ID NO: 1397 |
| 350_KC | LAQAKCSANAELDAY-GKSDFYKRLIDKAKTVEGVEALKDAILAAC-P | SEQ ID NO: 1398 |
| 350_CC | LAQAKCSANAELDAY-GCSDFYKRLIDKAKTVEGVEALKDAILAAC-P | SEQ ID NO: 1399 |
| 350_KK | LAQAKCSANAELDAY-GKSDFYKRLIDKAKTVEGVEALKDAILAAK-P | SEQ ID NO: 1400 |
| 351_CK | LAQAKCAANAELDCY-GKSDFYKRLIDKAKTVEGVEALKDAILAAK-P | SEQ ID NO: 1401 |
| 351_KC | LAQAKCAANAELDCY-GCSDFYKRLIDKAKTVEGVEALKDAILAAC-P | SEQ ID NO: 1402 |
| 351_CC | LAQAKCAANAELDCY-GCSDFYKRLIDKAKTVEGVEALKDAILAAC-P | SEQ ID NO: 1403 |
| 351_KK | LAQAKCAANAELDCY-GKSDFYKRLIDKAKTVEGVEALKDAILAAK-P | SEQ ID NO: 1404 |
| 352_CK | LAQAKCAANSELDCY-GKSDFYKRLIDKAKTVEGVEALKDAILAAK-P | SEQ ID NO: 1405 |
| 352_KC | LAQAKCAANSELDCY-GCSDFYKRLIDKAKTVEGVEALKDAILAAC-P | SEQ ID NO: 1406 |
| 352_CC | LAQAKCAANSELDCY-GCSDFYKRLIDKAKTVEGVEALKDAILAAC-P | SEQ ID NO: 1407 |
| 352_KK | LAQAKCAANSELDCY-GKSDFYKRLIDKAKTVEGVEALKDAILAAK-P | SEQ ID NO: 1408 |

Figure 1CCC

| Designation | Amino acid sequence | SEQ ID NO |
|---|---|---|
| 353_CK | LAQAKCAANAELDSY-GCSDFYKRLIDKAKTVEGVEALKDAILAAK-P | SEQ ID NO: 1409 |
| 353_KC | LAQAKCAANAELDSY-GKSDFYKRLIDKAKTVEGVEALKDAILAAC-P | SEQ ID NO: 1410 |
| 353_CC | LAQAKCAANAELDSY-GCSDFYKRLIDKAKTVEGVEALKDAILAAC-P | SEQ ID NO: 1411 |
| 353_KK | LAQAKCAANAELDSY-GKSDFYKRLIDKAKTVEGVEALKDAILAAK-P | SEQ ID NO: 1412 |
| 354_CK | LAQAKCAANSELDSY-GCSDFYKRLIDKAKTVEGVEALKDAILAAK-P | SEQ ID NO: 1413 |
| 354_KC | LAQAKCAANSELDSY-GKSDFYKRLIDKAKTVEGVEALKDAILAAC-P | SEQ ID NO: 1414 |
| 354_CC | LAQAKCAANSELDSY-GCSDFYKRLIDKAKTVEGVEALKDAILAAC-P | SEQ ID NO: 1415 |
| 354_KK | LAQAKCAANSELDSY-GKSDFYKRLIDKAKTVEGVEALKDAILAAK-P | SEQ ID NO: 1416 |
| 355_CK | LAQAKCSANSELDSY-GCSDFYKRLIDKAKTVEGVEALKDAILAAK-P | SEQ ID NO: 1417 |
| 355_KC | LAQAKCSANSELDSY-GKSDFYKRLIDKAKTVEGVEALKDAILAAC-P | SEQ ID NO: 1418 |
| 355_CC | LAQAKCSANSELDSY-GCSDFYKRLIDKAKTVEGVEALKDAILAAC-P | SEQ ID NO: 1419 |
| 355_KK | LAQAKCSANSELDSY-GKSDFYKRLIDKAKTVEGVEALKDAILAAK-P | SEQ ID NO: 1420 |
| 356_CK | LAQAKCSANAELDSY-GCSDFYKRLIDKAKTVEGVEALKDAILAAK-P | SEQ ID NO: 1421 |
| 356_KC | LAQAKCSANAELDSY-GKSDFYKRLIDKAKTVEGVEALKDAILAAC-P | SEQ ID NO: 1422 |
| 356_CC | LAQAKCSANAELDSY-GCSDFYKRLIDKAKTVEGVEALKDAILAAC-P | SEQ ID NO: 1423 |
| 356_KK | LAQAKCSANAELDSY-GKSDFYKRLIDKAKTVEGVEALKDAILAAK-P | SEQ ID NO: 1424 |
| 357_CK | LAQAKCAANAELDKY-GCSDFYKRLIDKAKTVEGVEALKDAILAAK-P | SEQ ID NO: 1425 |
| 357_KC | LAQAKCAANAELDKY-GKSDFYKRLIDKAKTVEGVEALKDAILAAC-P | SEQ ID NO: 1426 |
| 357_CC | LAQAKCAANAELDKY-GCSDFYKRLIDKAKTVEGVEALKDAILAAC-P | SEQ ID NO: 1427 |
| 357_KK | LAQAKCAANAELDKY-GKSDFYKRLIDKAKTVEGVEALKDAILAAK-P | SEQ ID NO: 1428 |
| 358_CK | LAQAKCAANSELDKY-GCSDFYKRLIDKAKTVEGVEALKDAILAAK-P | SEQ ID NO: 1429 |
| 358_KC | LAQAKCAANSELDKY-GKSDFYKRLIDKAKTVEGVEALKDAILAAC-P | SEQ ID NO: 1430 |
| 358_CC | LAQAKCAANSELDKY-GCSDFYKRLIDKAKTVEGVEALKDAILAAC-P | SEQ ID NO: 1431 |
| 358_KK | LAQAKCAANSELDKY-GKSDFYKRLIDKAKTVEGVEALKDAILAAK-P | SEQ ID NO: 1432 |
| 359_CK | LASAKCAANAELDAY-GCSDFYKRLIDKAKTVEGVEALKDAILAAK-P | SEQ ID NO: 1433 |
| 359_KC | LASAKCAANAELDAY-GKSDFYKRLIDKAKTVEGVEALKDAILAAC-P | SEQ ID NO: 1434 |

Figure 1DDD

| Designation | Amino acid sequence | SEQ ID NO |
|---|---|---|
| 359_CC | LASAKCAANAELDAY-GCSDFYKRLIDKAKTVEGVEALKDAILAAC-P | SEQ ID NO: 1435 |
| 359_KK | LASAKCAANAELDAY-GKSDFYKRLIDKAKTVEGVEALKDAILAAK-P | SEQ ID NO: 1436 |
| 360_CK | LASAKCAANSELDAY-GCSDFYKRLIDKAKTVEGVEALKDAILAAK-P | SEQ ID NO: 1437 |
| 360_KC | LASAKCAANSELDAY-GKSDFYKRLIDKAKTVEGVEALKDAILAAC-P | SEQ ID NO: 1438 |
| 360_CC | LASAKCAANSELDAY-GCSDFYKRLIDKAKTVEGVEALKDAILAAC-P | SEQ ID NO: 1439 |
| 360_KK | LASAKCAANSELDAY-GKSDFYKRLIDKAKTVEGVEALKDAILAAK-P | SEQ ID NO: 1440 |
| 361_CK | LASAKCSANSELDAY-GCSDFYKRLIDKAKTVEGVEALKDAILAAK-P | SEQ ID NO: 1441 |
| 361_KC | LASAKCSANSELDAY-GKSDFYKRLIDKAKTVEGVEALKDAILAAC-P | SEQ ID NO: 1442 |
| 361_CC | LASAKCSANSELDAY-GCSDFYKRLIDKAKTVEGVEALKDAILAAC-P | SEQ ID NO: 1443 |
| 361_KK | LASAKCSANSELDAY-GKSDFYKRLIDKAKTVEGVEALKDAILAAK-P | SEQ ID NO: 1444 |
| 362_CK | LASAKCSANAELDAY-GCSDFYKRLIDKAKTVEGVEALKDAILAAK-P | SEQ ID NO: 1445 |
| 362_KC | LASAKCSANAELDAY-GKSDFYKRLIDKAKTVEGVEALKDAILAAC-P | SEQ ID NO: 1446 |
| 362_CC | LASAKCSANAELDAY-GCSDFYKRLIDKAKTVEGVEALKDAILAAC-P | SEQ ID NO: 1447 |
| 362_KK | LASAKCSANAELDAY-GKSDFYKRLIDKAKTVEGVEALKDAILAAK-P | SEQ ID NO: 1448 |
| 363_CK | LASAKCAANAELDCY-GCSDFYKRLIDKAKTVEGVEALKDAILAAK-P | SEQ ID NO: 1449 |
| 363_KC | LASAKCAANAELDCY-GKSDFYKRLIDKAKTVEGVEALKDAILAAC-P | SEQ ID NO: 1450 |
| 363_CC | LASAKCAANAELDCY-GCSDFYKRLIDKAKTVEGVEALKDAILAAC-P | SEQ ID NO: 1451 |
| 363_KK | LASAKCAANAELDCY-GKSDFYKRLIDKAKTVEGVEALKDAILAAK-P | SEQ ID NO: 1452 |
| 364_CK | LASAKCAANSELDCY-GCSDFYKRLIDKAKTVEGVEALKDAILAAK-P | SEQ ID NO: 1453 |
| 364_KC | LASAKCAANSELDCY-GKSDFYKRLIDKAKTVEGVEALKDAILAAC-P | SEQ ID NO: 1454 |
| 364_CC | LASAKCAANSELDCY-GCSDFYKRLIDKAKTVEGVEALKDAILAAC-P | SEQ ID NO: 1455 |
| 364_KK | LASAKCAANSELDCY-GKSDFYKRLIDKAKTVEGVEALKDAILAAK-P | SEQ ID NO: 1456 |
| 365_CK | LASAKCAANAELDSY-GCSDFYKRLIDKAKTVEGVEALKDAILAAK-P | SEQ ID NO: 1457 |
| 365_KC | LASAKCAANAELDSY-GKSDFYKRLIDKAKTVEGVEALKDAILAAC-P | SEQ ID NO: 1458 |
| 365_CC | LASAKCAANAELDSY-GCSDFYKRLIDKAKTVEGVEALKDAILAAC-P | SEQ ID NO: 1459 |
| 365_KK | LASAKCAANAELDSY-GKSDFYKRLIDKAKTVEGVEALKDAILAAK-P | SEQ ID NO: 1460 |

Figure 1EEE

| Designation | Amino acid sequence | SEQ ID NO |
|---|---|---|
| 366_CK | LASAKCAANSELDSY-GCSDFYKRLIDKAKTVEGVEALKDAILAAK-P | SEQ ID NO: 1461 |
| 366_KC | LASAKCAANSELDSY-GKSDFYKRLIDKAKTVEGVEALKDAILAAC-P | SEQ ID NO: 1462 |
| 366_CC | LASAKCAANSELDSY-GCSDFYKRLIDKAKTVEGVEALKDAILAAC-P | SEQ ID NO: 1463 |
| 366_KK | LASAKCAANSELDSY-GKSDFYKRLIDKAKTVEGVEALKDAILAAK-P | SEQ ID NO: 1464 |
| 367_CK | LASAKCSANSELDSY-GCSDFYKRLIDKAKTVEGVEALKDAILAAK-P | SEQ ID NO: 1465 |
| 367_KC | LASAKCSANSELDSY-GKSDFYKRLIDKAKTVEGVEALKDAILAAC-P | SEQ ID NO: 1466 |
| 367_CC | LASAKCSANSELDSY-GCSDFYKRLIDKAKTVEGVEALKDAILAAC-P | SEQ ID NO: 1467 |
| 367_KK | LASAKCSANSELDSY-GKSDFYKRLIDKAKTVEGVEALKDAILAAK-P | SEQ ID NO: 1468 |
| 368_CK | LASAKCSANAELDSY-GCSDFYKRLIDKAKTVEGVEALKDAILAAK-P | SEQ ID NO: 1469 |
| 368_KC | LASAKCSANAELDSY-GKSDFYKRLIDKAKTVEGVEALKDAILAAC-P | SEQ ID NO: 1470 |
| 368_CC | LASAKCSANAELDSY-GCSDFYKRLIDKAKTVEGVEALKDAILAAC-P | SEQ ID NO: 1471 |
| 368_KK | LASAKCSANAELDSY-GKSDFYKRLIDKAKTVEGVEALKDAILAAK-P | SEQ ID NO: 1472 |
| 369_CK | LASAKCAANAELDKY-GCSDFYKRLIDKAKTVEGVEALKDAILAAK-P | SEQ ID NO: 1473 |
| 369_KC | LASAKCAANAELDKY-GKSDFYKRLIDKAKTVEGVEALKDAILAAC-P | SEQ ID NO: 1474 |
| 369_CC | LASAKCAANAELDKY-GCSDFYKRLIDKAKTVEGVEALKDAILAAC-P | SEQ ID NO: 1475 |
| 369_KK | LASAKCAANAELDKY-GKSDFYKRLIDKAKTVEGVEALKDAILAAK-P | SEQ ID NO: 1476 |
| 370_CK | LASAKCAANSELDKY-GCSDFYKRLIDKAKTVEGVEALKDAILAAK-P | SEQ ID NO: 1477 |
| 370_KC | LASAKCAANSELDKY-GKSDFYKRLIDKAKTVEGVEALKDAILAAC-P | SEQ ID NO: 1478 |
| 370_CC | LASAKCAANSELDKY-GCSDFYKRLIDKAKTVEGVEALKDAILAAC-P | SEQ ID NO: 1479 |
| 370_KK | LASAKCAANSELDKY-GKSDFYKRLIDKAKTVEGVEALKDAILAAK-P | SEQ ID NO: 1480 |
| 371_CK | LAEAKCAANAELDAY-GCSDFYKRLIDKAKTVEGVEALKDAILAAK-P | SEQ ID NO: 1481 |
| 371_KC | LAEAKCAANAELDAY-GKSDFYKRLIDKAKTVEGVEALKDAILAAC-P | SEQ ID NO: 1482 |
| 371_CC | LAEAKCAANAELDAY-GCSDFYKRLIDKAKTVEGVEALKDAILAAC-P | SEQ ID NO: 1483 |
| 371_KK | LAEAKCAANAELDAY-GKSDFYKRLIDKAKTVEGVEALKDAILAAK-P | SEQ ID NO: 1484 |
| 372_CK | LAEAKCAANSELDAY-GCSDFYKRLIDKAKTVEGVEALKDAILAAK-P | SEQ ID NO: 1485 |
| 372_KC | LAEAKCAANSELDAY-GKSDFYKRLIDKAKTVEGVEALKDAILAAC-P | SEQ ID NO: 1486 |

Figure 1FFF

| Designation | Amino acid sequence | SEQ ID NO |
|---|---|---|
| 372_CC | LAEAKCAANSELDAY-GCSDFYKRLIDKAKTVEGVEALKDAILAAC-P | SEQ ID NO: 1487 |
| 372_KK | LAEAKCAANSELDAY-GKSDFYKRLIDKAKTVEGVEALKDAILAAK-P | SEQ ID NO: 1488 |
| 373_CK | LAEAKCSANSELDAY-GCSDFYKRLIDKAKTVEGVEALKDAILAAK-P | SEQ ID NO: 1489 |
| 373_KC | LAEAKCSANSELDAY-GKSDFYKRLIDKAKTVEGVEALKDAILAAC-P | SEQ ID NO: 1490 |
| 373_CC | LAEAKCSANSELDAY-GCSDFYKRLIDKAKTVEGVEALKDAILAAC-P | SEQ ID NO: 1491 |
| 373_KK | LAEAKCSANSELDAY-GKSDFYKRLIDKAKTVEGVEALKDAILAAK-P | SEQ ID NO: 1492 |
| 374_CK | LAEAKCSANAELDAY-GCSDFYKRLIDKAKTVEGVEALKDAILAAK-P | SEQ ID NO: 1493 |
| 374_KC | LAEAKCSANAELDAY-GKSDFYKRLIDKAKTVEGVEALKDAILAAC-P | SEQ ID NO: 1494 |
| 374_CC | LAEAKCSANAELDAY-GCSDFYKRLIDKAKTVEGVEALKDAILAAC-P | SEQ ID NO: 1495 |
| 374_KK | LAEAKCSANAELDAY-GKSDFYKRLIDKAKTVEGVEALKDAILAAK-P | SEQ ID NO: 1496 |
| 375_CK | LAEAKCAANAELDCY-GCSDFYKRLIDKAKTVEGVEALKDAILAAK-P | SEQ ID NO: 1497 |
| 375_KC | LAEAKCAANAELDCY-GKSDFYKRLIDKAKTVEGVEALKDAILAAC-P | SEQ ID NO: 1498 |
| 375_CC | LAEAKCAANAELDCY-GCSDFYKRLIDKAKTVEGVEALKDAILAAC-P | SEQ ID NO: 1499 |
| 375_KK | LAEAKCAANAELDCY-GKSDFYKRLIDKAKTVEGVEALKDAILAAK-P | SEQ ID NO: 1500 |
| 376_CK | LAEAKCAANSELDCY-GCSDFYKRLIDKAKTVEGVEALKDAILAAK-P | SEQ ID NO: 1501 |
| 376_KC | LAEAKCAANSELDCY-GKSDFYKRLIDKAKTVEGVEALKDAILAAC-P | SEQ ID NO: 1502 |
| 376_CC | LAEAKCAANSELDCY-GCSDFYKRLIDKAKTVEGVEALKDAILAAC-P | SEQ ID NO: 1503 |
| 376_KK | LAEAKCAANSELDCY-GKSDFYKRLIDKAKTVEGVEALKDAILAAK-P | SEQ ID NO: 1504 |
| 377_CK | LAEAKCAANAELDSY-GCSDFYKRLIDKAKTVEGVEALKDAILAAK-P | SEQ ID NO: 1505 |
| 377_KC | LAEAKCAANAELDSY-GKSDFYKRLIDKAKTVEGVEALKDAILAAC-P | SEQ ID NO: 1506 |
| 377_CC | LAEAKCAANAELDSY-GCSDFYKRLIDKAKTVEGVEALKDAILAAC-P | SEQ ID NO: 1507 |
| 377_KK | LAEAKCAANAELDSY-GKSDFYKRLIDKAKTVEGVEALKDAILAAK-P | SEQ ID NO: 1508 |
| 378_CK | LAEAKCAANSELDSY-GCSDFYKRLIDKAKTVEGVEALKDAILAAK-P | SEQ ID NO: 1509 |
| 378_KC | LAEAKCAANSELDSY-GKSDFYKRLIDKAKTVEGVEALKDAILAAC-P | SEQ ID NO: 1510 |
| 378_CC | LAEAKCAANSELDSY-GCSDFYKRLIDKAKTVEGVEALKDAILAAC-P | SEQ ID NO: 1511 |
| 378_KK | LAEAKCAANSELDSY-GKSDFYKRLIDKAKTVEGVEALKDAILAAK-P | SEQ ID NO: 1512 |

Figure 1GGG

| Designation | Amino acid sequence | SEQ ID NO |
|---|---|---|
| 379_CK | LAEAKCSANSELDSY-GCSDFYKRLIDKAKTVEGVEALKDAILAAK-P | SEQ ID NO: 1513 |
| 379_KC | LAEAKCSANSELDSY-GKSDFYKRLIDKAKTVEGVEALKDAILAAC-P | SEQ ID NO: 1514 |
| 379_CC | LAEAKCSANSELDSY-GCSDFYKRLIDKAKTVEGVEALKDAILAAC-P | SEQ ID NO: 1515 |
| 379_KK | LAEAKCSANSELDSY-GKSDFYKRLIDKAKTVEGVEALKDAILAAK-P | SEQ ID NO: 1516 |
| 380_CK | LAEAKCSANAELDSY-GCSDFYKRLIDKAKTVEGVEALKDAILAAK-P | SEQ ID NO: 1517 |
| 380_KC | LAEAKCSANAELDSY-GKSDFYKRLIDKAKTVEGVEALKDAILAAC-P | SEQ ID NO: 1518 |
| 380_CC | LAEAKCSANAELDSY-GCSDFYKRLIDKAKTVEGVEALKDAILAAC-P | SEQ ID NO: 1519 |
| 380_KK | LAEAKCSANAELDSY-GKSDFYKRLIDKAKTVEGVEALKDAILAAK-P | SEQ ID NO: 1520 |
| 381_CK | LAEAKCSANAELDKY-GCSDFYKRLIDKAKTVEGVEALKDAILAAK-P | SEQ ID NO: 1521 |
| 381_KC | LAEAKCAANAELDKY-GKSDFYKRLIDKAKTVEGVEALKDAILAAC-P | SEQ ID NO: 1522 |
| 381_CC | LAEAKCAANAELDKY-GCSDFYKRLIDKAKTVEGVEALKDAILAAC-P | SEQ ID NO: 1523 |
| 381_KK | LAEAKCAANAELDKY-GKSDFYKRLIDKAKTVEGVEALKDAILAAK-P | SEQ ID NO: 1524 |
| 382_CK | LAEAKCAANSELDKY-GCSDFYKRLIDKAKTVEGVEALKDAILAAK-P | SEQ ID NO: 1525 |
| 382_KC | LAEAKCAANSELDKY-GKSDFYKRLIDKAKTVEGVEALKDAILAAC-P | SEQ ID NO: 1526 |
| 382_CC | LAEAKCAANSELDKY-GCSDFYKRLIDKAKTVEGVEALKDAILAAC-P | SEQ ID NO: 1527 |
| 382_KK | LAEAKCAANSELDKY-GKSDFYKRLIDKAKTVEGVEALKDAILAAK-P | SEQ ID NO: 1528 |
| 383_CK | LAEAKCAANAELDAY-GCSDFYKRLIDKAKTVEGVEALKDAILAAK-P | SEQ ID NO: 1529 |
| 383_KC | LAEAKCAANAELDAY-GKSDFYKRLIDKAKTVEGVEALKDAILAAC-P | SEQ ID NO: 1530 |
| 383_CC | LAEAKCAANAELDAY-GCSDFYKRLIDKAKTVEGVEALKDAILAAC-P | SEQ ID NO: 1531 |
| 383_KK | LAEAKCAANAELDAY-GKSDFYKRLIDKAKTVEGVEALKDAILAAK-P | SEQ ID NO: 1532 |
| 384_CK | LACAKCAANSELDAY-GCSDFYKRLIDKAKTVEGVEALKDAILAAK-P | SEQ ID NO: 1533 |
| 384_KC | LACAKCAANSELDAY-GKSDFYKRLIDKAKTVEGVEALKDAILAAC-P | SEQ ID NO: 1534 |
| 384_CC | LACAKCAANSELDAY-GCSDFYKRLIDKAKTVEGVEALKDAILAAC-P | SEQ ID NO: 1535 |
| 384_KK | LACAKCAANSELDAY-GKSDFYKRLIDKAKTVEGVEALKDAILAAK-P | SEQ ID NO: 1536 |
| 385_CK | LACAKCSANSELDAY-GCSDFYKRLIDKAKTVEGVEALKDAILAAK-P | SEQ ID NO: 1537 |
| 385_KC | LACAKCSANSELDAY-GKSDFYKRLIDKAKTVEGVEALKDAILAAC-P | SEQ ID NO: 1538 |

Figure 1HHH

| Designation | Amino acid sequence | SEQ ID NO |
|---|---|---|
| 385_CC | LACAKCSANSELDAY-GCSDFYKRLIDKAKTVEGVEALKDAILAAC-P | SEQ ID NO: 1539 |
| 385_KK | LACAKCSANSELDAY-GKSDFYKRLIDKAKTVEGVEALKDAILAAK-P | SEQ ID NO: 1540 |
| 386_CK | LACAKCSANAELDAY-GCSDFYKRLIDKAKTVEGVEALKDAILAAK-P | SEQ ID NO: 1541 |
| 386_KC | LACAKCSANAELDAY-GKSDFYKRLIDKAKTVEGVEALKDAILAAC-P | SEQ ID NO: 1542 |
| 386_CC | LACAKCSANAELDAY-GCSDFYKRLIDKAKTVEGVEALKDAILAAC-P | SEQ ID NO: 1543 |
| 386_KK | LACAKCSANAELDAY-GKSDFYKRLIDKAKTVEGVEALKDAILAAK-P | SEQ ID NO: 1544 |
| 387_CK | LACAKCAANAELDCY-GCSDFYKRLIDKAKTVEGVEALKDAILAAK-P | SEQ ID NO: 1545 |
| 387_KC | LACAKCAANAELDCY-GKSDFYKRLIDKAKTVEGVEALKDAILAAC-P | SEQ ID NO: 1546 |
| 387_CC | LACAKCAANAELDCY-GCSDFYKRLIDKAKTVEGVEALKDAILAAC-P | SEQ ID NO: 1547 |
| 387_KK | LACAKCAANAELDCY-GKSDFYKRLIDKAKTVEGVEALKDAILAAK-P | SEQ ID NO: 1548 |
| 388_CK | LACAKCAANSELDCY-GCSDFYKRLIDKAKTVEGVEALKDAILAAK-P | SEQ ID NO: 1549 |
| 388_KC | LACAKCAANSELDCY-GKSDFYKRLIDKAKTVEGVEALKDAILAAC-P | SEQ ID NO: 1550 |
| 388_CC | LACAKCAANSELDCY-GCSDFYKRLIDKAKTVEGVEALKDAILAAC-P | SEQ ID NO: 1551 |
| 388_KK | LACAKCAANSELDCY-GKSDFYKRLIDKAKTVEGVEALKDAILAAK-P | SEQ ID NO: 1552 |
| 389_CK | LACAKCAANAELDSY-GCSDFYKRLIDKAKTVEGVEALKDAILAAK-P | SEQ ID NO: 1553 |
| 389_KC | LACAKCAANAELDSY-GKSDFYKRLIDKAKTVEGVEALKDAILAAC-P | SEQ ID NO: 1554 |
| 389_CC | LACAKCAANAELDSY-GCSDFYKRLIDKAKTVEGVEALKDAILAAC-P | SEQ ID NO: 1555 |
| 389_KK | LACAKCAANAELDSY-GKSDFYKRLIDKAKTVEGVEALKDAILAAK-P | SEQ ID NO: 1556 |
| 390_CK | LACAKCAANSELDSY-GCSDFYKRLIDKAKTVEGVEALKDAILAAK-P | SEQ ID NO: 1557 |
| 390_KC | LACAKCAANSELDSY-GKSDFYKRLIDKAKTVEGVEALKDAILAAC-P | SEQ ID NO: 1558 |
| 390_CC | LACAKCAANSELDSY-GCSDFYKRLIDKAKTVEGVEALKDAILAAC-P | SEQ ID NO: 1559 |
| 390_KK | LACAKCAANSELDSY-GKSDFYKRLIDKAKTVEGVEALKDAILAAK-P | SEQ ID NO: 1560 |
| 391_CK | LACAKCSANSELDSY-GCSDFYKRLIDKAKTVEGVEALKDAILAAK-P | SEQ ID NO: 1561 |
| 391_KC | LACAKCSANSELDSY-GKSDFYKRLIDKAKTVEGVEALKDAILAAC-P | SEQ ID NO: 1562 |
| 391_CC | LACAKCSANSELDSY-GCSDFYKRLIDKAKTVEGVEALKDAILAAC-P | SEQ ID NO: 1563 |
| 391_KK | LACAKCSANSELDSY-GKSDFYKRLIDKAKTVEGVEALKDAILAAK-P | SEQ ID NO: 1564 |

Figure 1III

| Designation | Amino acid sequence | SEQ ID NO |
|---|---|---|
| 392_CK | LACAKCSANAELDSY-GCSDFYKRLIDKAKTVEGVEALKDAILAAK-P | SEQ ID NO: 1565 |
| 392_KC | LACAKCSANAELDSY-GKSDFYKRLIDKAKTVEGVEALKDAILAAC-P | SEQ ID NO: 1566 |
| 392_CC | LACAKCSANAELDSY-GCSDFYKRLIDKAKTVEGVEALKDAILAAC-P | SEQ ID NO: 1567 |
| 392_KK | LACAKCSANAELDSY-GKSDFYKRLIDKAKTVEGVEALKDAILAAK-P | SEQ ID NO: 1568 |
| 393_CK | LACAKCAANAELDKY-GCSDFYKRLIDKAKTVEGVEALKDAILAAK-P | SEQ ID NO: 1569 |
| 393_KC | LACAKCAANAELDKY-GKSDFYKRLIDKAKTVEGVEALKDAILAAC-P | SEQ ID NO: 1570 |
| 393_CC | LACAKCAANAELDKY-GCSDFYKRLIDKAKTVEGVEALKDAILAAC-P | SEQ ID NO: 1571 |
| 393_KK | LACAKCAANAELDKY-GKSDFYKRLIDKAKTVEGVEALKDAILAAK-P | SEQ ID NO: 1572 |
| 394_CK | LACAKCAANSELDKY-GCSDFYKRLIDKAKTVEGVEALKDAILAAK-P | SEQ ID NO: 1573 |
| 394_KC | LACAKCAANSELDKY-GKSDFYKRLIDKAKTVEGVEALKDAILAAC-P | SEQ ID NO: 1574 |
| 394_CC | LACAKCAANSELDKY-GCSDFYKRLIDKAKTVEGVEALKDAILAAC-P | SEQ ID NO: 1575 |
| 394_KK | LACAKCAANSELDKY-GKSDFYKRLIDKAKTVEGVEALKDAILAAK-P | SEQ ID NO: 1576 |
| 395_CK | LAEAKEAANRELDSY-GCSDFYKRLIDKAKTVEGVEALKDAILAAK-P | SEQ ID NO: 1577 |
| 395_KC | LAEAKEAANRELDSY-GKSDFYKRLIDKAKTVEGVEALKDAILAAC-P | SEQ ID NO: 1578 |
| 395_CC | LAEAKEAANRELDSY-GCSDFYKRLIDKAKTVEGVEALKDAILAAC-P | SEQ ID NO: 1579 |
| 395_KK | LAEAKEAANRELDSY-GKSDFYKRLIDKAKTVEGVEALKDAILAAK-P | SEQ ID NO: 1580 |
| 396_CK | LAEAKEAANAELDSY-GCSDFYKRLIEKAKTVEGVEALKDAILAAK-P | SEQ ID NO: 1581 |
| 396_KC | LAEAKEAANAELDSY-GKSDFYKRLIEKAKTVEGVEALKDAILAAC-P | SEQ ID NO: 1582 |
| 396_CC | LAEAKEAANAELDSY-GCSDFYKRLIEKAKTVEGVEALKDAILAAC-P | SEQ ID NO: 1583 |
| 396_KK | LAEAKEAANAELDSY-GKSDFYKRLIEKAKTVEGVEALKDAILAAK-P | SEQ ID NO: 1584 |
| 397_CK | LAEAKEAANAELDSY-GCSDFYKRLIDKAKTVEGVEALKEAILAAK-P | SEQ ID NO: 1585 |
| 397_KC | LAEAKEAANAELDSY-GKSDFYKRLIDKAKTVEGVEALKEAILAAC-P | SEQ ID NO: 1586 |
| 397_CC | LAEAKEAANAELDSY-GCSDFYKRLIDKAKTVEGVEALKEAILAAC-P | SEQ ID NO: 1587 |
| 397_KK | LAEAKEAANAELDSY-GKSDFYKRLIDKAKTVEGVEALKEAILAAK-P | SEQ ID NO: 1588 |
| 398_CK | LAEAKEAANAELDSY-GCSDFYKRLIEKAKTVEGVEALKEAILAAK-P | SEQ ID NO: 1589 |
| 398_KC | LAEAKEAANAELDSY-GKSDFYKRLIEKAKTVEGVEALKEAILAAC-P | SEQ ID NO: 1590 |

Figure 1JJJ

| Designation | Amino acid sequence | SEQ ID NO |
|---|---|---|
| 398_CC | LAEAKEAANAELDSY-GCSDFYKRLIEKAKTVEGVEALKEAILAAC-P | SEQ ID NO: 1591 |
| 398_KK | LAEAKEAANAELDSY-GKSDFYKRLIEKAKTVEGVEALKEAILAAK-P | SEQ ID NO: 1592 |
| 399_CK | LAEAKEAANRELDSY-GCSDFYKRLIEKAKTVEGVEALKEAILAAK-P | SEQ ID NO: 1593 |
| 399_KC | LAEAKEAANRELDSY-GKSDFYKRLIEKAKTVEGVEALKEAILAAC-P | SEQ ID NO: 1594 |
| 399_CC | LAEAKEAANRELDSY-GCSDFYKRLIEKAKTVEGVEALKEAILAAC-P | SEQ ID NO: 1595 |
| 399_KK | LAEAKEAANRELDSY-GKSDFYKRLIEKAKTVEGVEALKEAILAAK-P | SEQ ID NO: 1596 |
| 400_CK | LAEAKEAANAELDSY-GCSDFYKRLIDKAKTVEGVEALKDAILKAK-P | SEQ ID NO: 1597 |
| 400_KC | LAEAKEAANAELDSY-GKSDFYKRLIDKAKTVEGVEALKDAILKAC-P | SEQ ID NO: 1598 |
| 400_CC | LAEAKEAANAELDSY-GCSDFYKRLIDKAKTVEGVEALKDAILKAC-P | SEQ ID NO: 1599 |
| 400_KK | LAEAKEAANAELDSY-GKSDFYKRLIDKAKTVEGVEALKDAILKAK-P | SEQ ID NO: 1600 |
| 401_CK | LAEAKEAANAELDSY-GCSDFYKRLIDKAKTVEGVEALKDAILAAK-P | SEQ ID NO: 1601 |
| 401_KC | LAEAKEAANAELDSY-GKSDFYKRLIDKAKTVEGVEALKDAILAAC-P | SEQ ID NO: 1602 |
| 401_CC | LAEAKEAANAELDSY-GCSDFYKRLIDKAKTVEGVEALKDAILAAC-P | SEQ ID NO: 1603 |
| 401_KK | LAEAKEAANAELDSY-GKSDFYKRLIDKAKTVEGVEALKDAILAAK-P | SEQ ID NO: 1604 |
| 402_CK | LAEAKEAANRELDAY-GCSDFYKRLIDKAKTVEGVEALKDAILAAK-P | SEQ ID NO: 1605 |
| 402_KC | LAEAKEAANRELDAY-GKSDFYKRLIDKAKTVEGVEALKDAILAAC-P | SEQ ID NO: 1606 |
| 402_CC | LAEAKEAANRELDAY-GCSDFYKRLIDKAKTVEGVEALKDAILAAC-P | SEQ ID NO: 1607 |
| 402_KK | LAEAKEAANRELDAY-GKSDFYKRLIDKAKTVEGVEALKDAILAAK-P | SEQ ID NO: 1608 |
| 403_CK | LAEAKEAANRELDAY-GCSDFYKRLIEKAKTVEGVEALKDAILAAK-P | SEQ ID NO: 1609 |
| 403_KC | LAEAKEAANRELDAY-GKSDFYKRLIEKAKTVEGVEALKDAILAAC-P | SEQ ID NO: 1610 |
| 403_CC | LAEAKEAANRELDAY-GCSDFYKRLIEKAKTVEGVEALKDAILAAC-P | SEQ ID NO: 1611 |
| 403_KK | LAEAKEAANRELDAY-GKSDFYKRLIEKAKTVEGVEALKDAILAAK-P | SEQ ID NO: 1612 |
| 404_CK | LAEAKEAANAELDAY-GCSDFYKRLIDKAKTVEGVEALKEAILAAK-P | SEQ ID NO: 1613 |
| 404_KC | LAEAKEAANAELDAY-GKSDFYKRLIDKAKTVEGVEALKEAILAAC-P | SEQ ID NO: 1614 |
| 404_CC | LAEAKEAANAELDAY-GCSDFYKRLIDKAKTVEGVEALKEAILAAC-P | SEQ ID NO: 1615 |
| 404_KK | LAEAKEAANAELDAY-GKSDFYKRLIDKAKTVEGVEALKEAILAAK-P | SEQ ID NO: 1616 |

Figure 1KKK

| Designation | Amino acid sequence | SEQ ID NO |
|---|---|---|
| 405_CK | LAEAKEAANAELDAY-GCSDFYKRLIEKAKTVEGVEALKEAILAAK-P | SEQ ID NO: 1617 |
| 405_KC | LAEAKEAANAELDAY-GKSDFYKRLIEKAKTVEGVEALKEAILAAC-P | SEQ ID NO: 1618 |
| 405_CC | LAEAKEAANAELDAY-GCSDFYKRLIEKAKTVEGVEALKEAILAAC-P | SEQ ID NO: 1619 |
| 405_KK | LAEAKEAANAELDAY-GKSDFYKRLIEKAKTVEGVEALKEAILAAK-P | SEQ ID NO: 1620 |
| 406_CK | LAEAKEAANRELDAY-GCSDFYKRLIEKAKTVEGVEALKEAILAAK-P | SEQ ID NO: 1621 |
| 406_KC | LAEAKEAANRELDAY-GKSDFYKRLIEKAKTVEGVEALKEAILAAC-P | SEQ ID NO: 1622 |
| 406_CC | LAEAKEAANRELDAY-GCSDFYKRLIEKAKTVEGVEALKEAILAAC-P | SEQ ID NO: 1623 |
| 406_KK | LAEAKEAANRELDAY-GKSDFYKRLIEKAKTVEGVEALKEAILAAK-P | SEQ ID NO: 1624 |
| 407_CK | LAEAKEAANRELDAY-GCSDFYKRLIDKAKTVEGVEALKDAILKAK-P | SEQ ID NO: 1625 |
| 407_KC | LAEAKEAANRELDAY-GKSDFYKRLIDKAKTVEGVEALKDAILKAC-P | SEQ ID NO: 1626 |
| 407_CC | LAEAKEAANRELDAY-GCSDFYKRLIDKAKTVEGVEALKDAILKAC-P | SEQ ID NO: 1627 |
| 407_KK | LAEAKEAANRELDAY-GKSDFYKRLIDKAKTVEGVEALKDAILKAK-P | SEQ ID NO: 1628 |
| 408_CK | LAEAKEAANAELDAY-GCSDFYKRLIDKAKTVEGVEALKDAILKAK-P | SEQ ID NO: 1629 |
| 408_KC | LAEAKEAANAELDAY-GKSDFYKRLIDKAKTVEGVEALKDAILKAC-P | SEQ ID NO: 1630 |
| 408_CC | LAEAKEAANAELDAY-GCSDFYKRLIDKAKTVEGVEALKDAILKAC-P | SEQ ID NO: 1631 |
| 408_KK | LAEAKEAANAELDAY-GKSDFYKRLIDKAKTVEGVEALKDAILKAK-P | SEQ ID NO: 1632 |
| 409_CK | LAQAKEAANRELDAY-GCSDFYKRLIEKAKTVEGVEALKDAILAAK-P | SEQ ID NO: 1633 |
| 409_KC | LAQAKEAANRELDAY-GKSDFYKRLIEKAKTVEGVEALKDAILAAC-P | SEQ ID NO: 1634 |
| 409_CC | LAQAKEAANRELDAY-GCSDFYKRLIEKAKTVEGVEALKDAILAAC-P | SEQ ID NO: 1635 |
| 409_KK | LAQAKEAANRELDAY-GKSDFYKRLIEKAKTVEGVEALKDAILAAK-P | SEQ ID NO: 1636 |
| 410_CK | LAQAKEAANAELDAY-GCSDFYKRLIEKAKTVEGVEALKDAILAAK-P | SEQ ID NO: 1637 |
| 410_KC | LAQAKEAANAELDAY-GKSDFYKRLIEKAKTVEGVEALKDAILAAC-P | SEQ ID NO: 1638 |
| 410_CC | LAQAKEAANAELDAY-GCSDFYKRLIEKAKTVEGVEALKDAILAAC-P | SEQ ID NO: 1639 |
| 410_KK | LAQAKEAANAELDAY-GKSDFYKRLIEKAKTVEGVEALKDAILAAK-P | SEQ ID NO: 1640 |
| 411_CK | LAQAKEAANAELDAY-GCSDFYKRLIDKAKTVEGVEALKDAILAAK-P | SEQ ID NO: 1641 |
| 411_KC | LAQAKEAANAELDAY-GKSDFYKRLIDKAKTVEGVEALKDAILAAC-P | SEQ ID NO: 1642 |

Figure 1LLL

| Designation | Amino acid sequence | SEQ ID NO |
|---|---|---|
| 411_CC | LAQAKEAANAELDAY-GCSDFYKRLIDKAKTVEGVEALKEAILAAC-P | SEQ ID NO: 1643 |
| 411_KK | LAQAKEAANAELDAY-GKSDFYKRLIDKAKTVEGVEALKEAILAAK-P | SEQ ID NO: 1644 |
| 412_CK | LAQAKEAANAELDAY-GCSDFYKRLIEKAKTVEGVEALKEAILAAK-P | SEQ ID NO: 1645 |
| 412_KC | LAQAKEAANAELDAY-GKSDFYKRLIEKAKTVEGVEALKEAILAAC-P | SEQ ID NO: 1646 |
| 412_CC | LAQAKEAANAELDAY-GCSDFYKRLIEKAKTVEGVEALKEAILAAC-P | SEQ ID NO: 1647 |
| 412_KK | LAQAKEAANAELDAY-GKSDFYKRLIEKAKTVEGVEALKEAILAAK-P | SEQ ID NO: 1648 |
| 413_CK | LAQAKEAANRELDAY-GCSDFYKRLIEKAKTVEGVEALKEAILAAK-P | SEQ ID NO: 1649 |
| 413_KC | LAQAKEAANRELDAY-GKSDFYKRLIEKAKTVEGVEALKEAILAAC-P | SEQ ID NO: 1650 |
| 413_CC | LAQAKEAANRELDAY-GCSDFYKRLIEKAKTVEGVEALKEAILAAC-P | SEQ ID NO: 1651 |
| 413_KK | LAQAKEAANRELDAY-GKSDFYKRLIEKAKTVEGVEALKEAILAAK-P | SEQ ID NO: 1652 |
| 414_CK | LAQAKEAANAELDAY-GCSDFYKRLIDKAKTVEGVEALKDAILKAK-P | SEQ ID NO: 1653 |
| 414_KC | LAQAKEAANAELDAY-GKSDFYKRLIDKAKTVEGVEALKDAILKAC-P | SEQ ID NO: 1654 |
| 414_CC | LAQAKEAANAELDAY-GCSDFYKRLIDKAKTVEGVEALKDAILKAC-P | SEQ ID NO: 1655 |
| 414_KK | LAQAKEAANAELDAY-GKSDFYKRLIDKAKTVEGVEALKDAILKAK-P | SEQ ID NO: 1656 |
| 415_CK | LAQAKEAANAELDAY-GCSDFYKRLIDKAKTVEGVEALKDAILAAK-P | SEQ ID NO: 1657 |
| 415_KC | LAQAKEAANAELDAY-GKSDFYKRLIDKAKTVEGVEALKDAILAAC-P | SEQ ID NO: 1658 |
| 415_CC | LAQAKEAANAELDAY-GCSDFYKRLIDKAKTVEGVEALKDAILAAC-P | SEQ ID NO: 1659 |
| 415_KK | LAQAKEAANAELDAY-GKSDFYKRLIDKAKTVEGVEALKDAILAAK-P | SEQ ID NO: 1660 |
| 416_CK | LAQAKEAANRELDAY-GCSDFYKRLIDKAKTVEGVEALKDAILAAK-P | SEQ ID NO: 1661 |
| 416_KC | LAQAKEAANRELDAY-GKSDFYKRLIDKAKTVEGVEALKDAILAAC-P | SEQ ID NO: 1662 |
| 416_CC | LAQAKEAANRELDSY-GCSDFYKRLIDKAKTVEGVEALKDAILAAC-P | SEQ ID NO: 1663 |
| 416_KK | LAQAKEAANRELDSY-GKSDFYKRLIDKAKTVEGVEALKDAILAAK-P | SEQ ID NO: 1664 |
| 417_CK | LAQAKEAANAELDSY-GCSDFYKRLIEKAKTVEGVEALKDAILAAK-P | SEQ ID NO: 1665 |
| 417_KC | LAQAKEAANAELDSY-GKSDFYKRLIEKAKTVEGVEALKDAILAAC-P | SEQ ID NO: 1666 |
| 417_CC | LAQAKEAANAELDSY-GCSDFYKRLIEKAKTVEGVEALKDAILAAC-P | SEQ ID NO: 1667 |
| 417_KK | LAQAKEAANAELDSY-GKSDFYKRLIEKAKTVEGVEALKDAILAAK-P | SEQ ID NO: 1668 |

Figure 1MMM

| Designation | Amino acid sequence | SEQ ID NO |
|---|---|---|
| 418_CK | LAQAKEAANAELDSY-GCSDFYKRLIDKAKTVEGVEALKEAILAAK-P | SEQ ID NO: 1669 |
| 418_KC | LAQAKEAANAELDSY-GKSDFYKRLIDKAKTVEGVEALKEAILAAC-P | SEQ ID NO: 1670 |
| 418_CC | LAQAKEAANAELDSY-GCSDFYKRLIDKAKTVEGVEALKEAILAAC-P | SEQ ID NO: 1671 |
| 418_KK | LAQAKEAANAELDSY-GKSDFYKRLIDKAKTVEGVEALKEAILAAK-P | SEQ ID NO: 1672 |
| 419_CK | LAQAKEAANAELDSY-GCSDFYKRLIEKAKTVEGVEALKEAILAAK-P | SEQ ID NO: 1673 |
| 419_KC | LAQAKEAANAELDSY-GKSDFYKRLIEKAKTVEGVEALKEAILAAC-P | SEQ ID NO: 1674 |
| 419_CC | LAQAKEAANAELDSY-GCSDFYKRLIEKAKTVEGVEALKEAILAAC-P | SEQ ID NO: 1675 |
| 419_KK | LAQAKEAANRELDSY-GKSDFYKRLIEKAKTVEGVEALKEAILAAK-P | SEQ ID NO: 1676 |
| 420_CK | LAQAKEAANRELDSY-GCSDFYKRLIEKAKTVEGVEALKEAILAAK-P | SEQ ID NO: 1677 |
| 420_KC | LAQAKEAANRELDSY-GKSDFYKRLIEKAKTVEGVEALKEAILAAC-P | SEQ ID NO: 1678 |
| 420_CC | LAQAKEAANRELDSY-GCSDFYKRLIEKAKTVEGVEALKEAILAAC-P | SEQ ID NO: 1679 |
| 420_KK | LAQAKEAANAELDSY-GKSDFYKRLIEKAKTVEGVEALKEAILAAK-P | SEQ ID NO: 1680 |
| 421_CK | LAQAKEAANAELDSY-GCSDFYKRLIDKAKTVEGVEALKDAILKAK-P | SEQ ID NO: 1681 |
| 421_KC | LAQAKEAANAELDSY-GKSDFYKRLIDKAKTVEGVEALKDAILKAC-P | SEQ ID NO: 1682 |
| 421_CC | LAQAKEAANAELDSY-GCSDFYKRLIDKAKTVEGVEALKDAILKAC-P | SEQ ID NO: 1683 |
| 421_KK | LAQAKEAANAELDSY-GKSDFYKRLIDKAKTVEGVEALKDAILKAK-P | SEQ ID NO: 1684 |
| 422_CK | LAQAKEAANAELDSY-GCSDFYKRLIDKAKTVEGVEALKDAILAAK-P | SEQ ID NO: 1685 |
| 422_KC | LAQAKEAANAELDSY-GKSDFYKRLIDKAKTVEGVEALKDAILAAC-P | SEQ ID NO: 1686 |
| 422_CC | LAQAKEAANAELDSY-GCSDFYKRLIDKAKTVEGVEALKDAILAAC-P | SEQ ID NO: 1687 |
| 422_KK | LAQAKEAANAELDSY-GKSDFYKRLIDKAKTVEGVEALKDAILAAK-P | SEQ ID NO: 1688 |
| 423_CK | LAEAKEAANRELDCY-GCSDFYKRLIDKAKTVEGVEALKDAILAAK-P | SEQ ID NO: 1689 |
| 423_KC | LAEAKEAANRELDCY-GKSDFYKRLIDKAKTVEGVEALKDAILAAC-P | SEQ ID NO: 1690 |
| 423_CC | LAEAKEAANRELDCY-GCSDFYKRLIDKAKTVEGVEALKDAILAAC-P | SEQ ID NO: 1691 |
| 423_KK | LAEAKEAANRELDCY-GKSDFYKRLIDKAKTVEGVEALKDAILAAK-P | SEQ ID NO: 1692 |
| 424_CK | LAEAKEAANRELDCY-GCSDFYKRLIEKAKTVEGVEALKDAILAAK-P | SEQ ID NO: 1693 |
| 424_KC | LAEAKEAANRELDCY-GKSDFYKRLIEKAKTVEGVEALKDAILAAC-P | SEQ ID NO: 1694 |

Figure 1NNN

| Designation | Amino acid sequence | SEQ ID NO |
|---|---|---|
| 424_CC | LAEAKEAANAELDCY-GCSDFYKRLIEKAKTVEGVEALKDAILAAC-P | SEQ ID NO: 1695 |
| 424_KK | LAEAKEAANAELDCY-GKSDFYKRLIEKAKTVEGVEALKDAILAAK-P | SEQ ID NO: 1696 |
| 425_CK | LAEAKEAANAELDCY-GCSDFYKRLIDKAKTVEGVEALKEAILAAK-P | SEQ ID NO: 1697 |
| 425_KC | LAEAKEAANAELDCY-GKSDFYKRLIDKAKTVEGVEALKEAILAAC-P | SEQ ID NO: 1698 |
| 425_CC | LAEAKEAANAELDCY-GCSDFYKRLIDKAKTVEGVEALKEAILAAC-P | SEQ ID NO: 1699 |
| 425_KK | LAEAKEAANAELDCY-GKSDFYKRLIDKAKTVEGVEALKEAILAAK-P | SEQ ID NO: 1700 |
| 426_CK | LAEAKEAANAELDCY-GCSDFYKRLIEKAKTVEGVEALKEAILAAK-P | SEQ ID NO: 1701 |
| 426_KC | LAEAKEAANAELDCY-GKSDFYKRLIEKAKTVEGVEALKEAILAAC-P | SEQ ID NO: 1702 |
| 426_CC | LAEAKEAANAELDCY-GCSDFYKRLIEKAKTVEGVEALKEAILAAC-P | SEQ ID NO: 1703 |
| 426_KK | LAEAKEAANAELDCY-GKSDFYKRLIEKAKTVEGVEALKEAILAAK-P | SEQ ID NO: 1704 |
| 427_CK | LAEAKEAANRELDCY-GCSDFYKRLIEKAKTVEGVEALKEAILAAK-P | SEQ ID NO: 1705 |
| 427_KC | LAEAKEAANRELDCY-GKSDFYKRLIEKAKTVEGVEALKEAILAAC-P | SEQ ID NO: 1706 |
| 427_CC | LAEAKEAANRELDCY-GCSDFYKRLIEKAKTVEGVEALKEAILAAC-P | SEQ ID NO: 1707 |
| 427_KK | LAEAKEAANRELDCY-GKSDFYKRLIEKAKTVEGVEALKEAILAAK-P | SEQ ID NO: 1708 |
| 428_CK | LAEAKEAANAELDCY-GCSDFYKRLIDKAKTVEGVEALKDAILKAK-P | SEQ ID NO: 1709 |
| 428_KC | LAEAKEAANAELDCY-GKSDFYKRLIDKAKTVEGVEALKDAILKAC-P | SEQ ID NO: 1710 |
| 428_CC | LAEAKEAANAELDCY-GCSDFYKRLIDKAKTVEGVEALKDAILKAC-P | SEQ ID NO: 1711 |
| 428_KK | LAEAKEAANAELDCY-GKSDFYKRLIDKAKTVEGVEALKDAILKAK-P | SEQ ID NO: 1712 |
| 429_CK | LAEAKEAANAELDCY-GCSDFYKRLIDKAKTVEGVEALKDAILAAK-P | SEQ ID NO: 1713 |
| 429_KC | LAEAKEAANAELDCY-GKSDFYKRLIDKAKTVEGVEALKDAILAAC-P | SEQ ID NO: 1714 |
| 429_CC | LAEAKEAANAELDCY-GCSDFYKRLIDKAKTVEGVEALKDAILAAC-P | SEQ ID NO: 1715 |
| 429_KK | LAEAKEAANAELDCY-GKSDFYKRLIDKAKTVEGVEALKDAILAAK-P | SEQ ID NO: 1716 |
| 430_CK | LAEAKEAANAELDSY-GCSDFYKRLIDKAKTVEGVEALKDAILAAK | SEQ ID NO: 1717 |
| 430_KC | LAEAKEAANAELDSY-GKSDFYKRLIDKAKTVEGVEALKDAILAAC | SEQ ID NO: 1718 |
| 430_CC | LAEAKEAANAELDSY-GCSDFYKRLIDKAKTVEGVEALKDAILAAC | SEQ ID NO: 1719 |
| 430_KK | LAEAKEAANAELDSY-GKSDFYKRLIDKAKTVEGVEALKDAILAAK | SEQ ID NO: 1720 |

Figure 1000

| Designation | Amino acid sequence | SEQ ID NO |
|---|---|---|
| 431_CK | LAEAKEAANAELDAY-GCSDFYKRLIDKAKTVEGVEALKDAILAAK | SEQ ID NO: 1721 |
| 431_KC | LAEAKEAANAELDAY-GKSDFYKRLIDKAKTVEGVEALKDAILAAC | SEQ ID NO: 1722 |
| 431_CC | LAEAKEAANAELDAY-GCSDFYKRLIDKAKTVEGVEALKDAILAAC | SEQ ID NO: 1723 |
| 431_KK | LAEAKEAANAELDAY-GKSDFYKRLIDKAKTVEGVEALKDAILAAK | SEQ ID NO: 1724 |
| 432_CK | LAQAKEAANAELDAY-GCSDFYKRLIDKAKTVEGVEALKDAILAAK | SEQ ID NO: 1725 |
| 432_KC | LAQAKEAANAELDAY-GKSDFYKRLIDKAKTVEGVEALKDAILAAC | SEQ ID NO: 1726 |
| 432_CC | LAQAKEAANAELDAY-GCSDFYKRLIDKAKTVEGVEALKDAILAAC | SEQ ID NO: 1727 |
| 432_KK | LAQAKEAANAELDAY-GKSDFYKRLIDKAKTVEGVEALKDAILAAK | SEQ ID NO: 1728 |
| 433_CK | LAQAKEAANAELDSY-GCSDFYKRLIDKAKTVEGVEALKDAILAAK | SEQ ID NO: 1729 |
| 433_KC | LAQAKEAANAELDSY-GKSDFYKRLIDKAKTVEGVEALKDAILAAC | SEQ ID NO: 1730 |
| 433_CC | LAQAKEAANAELDSY-GCSDFYKRLIDKAKTVEGVEALKDAILAAC | SEQ ID NO: 1731 |
| 433_KK | LAQAKEAANAELDSY-GKSDFYKRLIDKAKTVEGVEALKDAILAAK | SEQ ID NO: 1732 |
| 434_CK | LAEAKEAANAELDCY-GCSDFYKRLIDKAKTVEGVEALKDAILAAK | SEQ ID NO: 1733 |
| 434_KC | LAEAKEAANAELDCY-GKSDFYKRLIDKAKTVEGVEALKDAILAAC | SEQ ID NO: 1734 |
| 434_CC | LAEAKEAANAELDCY-GCSDFYKRLIDKAKTVEGVEALKDAILAAC | SEQ ID NO: 1735 |
| 434_KK | LAEAKEAANAELDCY-GKSDFYKRLIDKAKTVEGVEALKDAILAAK | SEQ ID NO: 1736 |
| 435_CK | LAEAKEAANAELDSY-GCSDFYKKLIDKAKTVEGVEALKDAILAAK-P | SEQ ID NO: 1737 |
| 435_KC | LAEAKEAANAELDSY-GKSDFYKKLIDKAKTVEGVEALKDAILAAC-P | SEQ ID NO: 1738 |
| 435_CC | LAEAKEAANAELDSY-GCSDFYKKLIDKAKTVEGVEALKDAILAAC-P | SEQ ID NO: 1739 |
| 435_KK | LAEAKEAANAELDSY-GKSDFYKKLIDKAKTVEGVEALKDAILAAK-P | SEQ ID NO: 1740 |
| 436_CK | LAEAKEAANAELDSY-GCSDFYKKLIDKAKTVEGVEALKDEILAAK-P | SEQ ID NO: 1741 |
| 436_KC | LAEAKEAANAELDSY-GKSDFYKKLIDKAKTVEGVEALKDEILAAC-P | SEQ ID NO: 1742 |
| 436_CC | LAEAKEAANAELDSY-GCSDFYKKLIDKAKTVEGVEALKDEILAAC-P | SEQ ID NO: 1743 |
| 436_KK | LAEAKEAANAELDSY-GKSDFYKKLIDKAKTVEGVEALKDEILAAK-P | SEQ ID NO: 1744 |
| 437_CK | LAEAKEAANAELDSY-GCSDFYKKLIDKAKTVEGVEALKEAILAAK-P | SEQ ID NO: 1745 |
| 437_KC | LAEAKEAANAELDSY-GKSDFYKKLIDKAKTVEGVEALKEAILAAC-P | SEQ ID NO: 1746 |

Figure 1PPP

| Designation | Amino acid sequence | SEQ ID NO |
|---|---|---|
| 437_CC | LAEAKEAANAELDSY-GCSDFYKKLIDKAKTVEGVEALKEAILAAC-P | SEQ ID NO: 1747 |
| 437_KK | LAEAKEAANAELDSY-GKSDFYKKLIDKAKTVEGVEALKEAILAAK-P | SEQ ID NO: 1748 |
| 438_CK | LAEAKEAANAELDSY-GCSDFYKKLIDKAKTVEGVEALKEEILAAK-P | SEQ ID NO: 1749 |
| 438_KC | LAEAKEAANAELDSY-GKSDFYKKLIDKAKTVEGVEALKEEILAAC-P | SEQ ID NO: 1750 |
| 438_CC | LAEAKEAANAELDSY-GCSDFYKKLIDKAKTVEGVEALKEEILAAC-P | SEQ ID NO: 1751 |
| 438_KK | LAEAKEAANAELDSY-GKSDFYKKLIDKAKTVEGVEALKEEILAAK-P | SEQ ID NO: 1752 |
| 439_CK | LAEAKEAANAELDSY-GCSDFYKKLIEKAKTVEGVEALKDAILAAK-P | SEQ ID NO: 1753 |
| 439_KC | LAEAKEAANAELDSY-GKSDFYKKLIEKAKTVEGVEALKDAILAAC-P | SEQ ID NO: 1754 |
| 439_CC | LAEAKEAANAELDSY-GCSDFYKKLIEKAKTVEGVEALKDAILAAC-P | SEQ ID NO: 1755 |
| 439_KK | LAEAKEAANAELDSY-GKSDFYKKLIEKAKTVEGVEALKDAILAAK-P | SEQ ID NO: 1756 |
| 440_CK | LAEAKEAANAELDSY-GCSDFYKKLIEKAKTVEGVEALKDEILAAK-P | SEQ ID NO: 1757 |
| 440_KC | LAEAKEAANAELDSY-GKSDFYKKLIEKAKTVEGVEALKDEILAAC-P | SEQ ID NO: 1758 |
| 440_CC | LAEAKEAANAELDSY-GCSDFYKKLIEKAKTVEGVEALKDEILAAC-P | SEQ ID NO: 1759 |
| 440_KK | LAEAKEAANAELDSY-GKSDFYKKLIEKAKTVEGVEALKDEILAAK-P | SEQ ID NO: 1760 |
| 441_CK | LAEAKEAANAELDSY-GCSDFYKKLIEKAKTVEGVEALKEAILAAK-P | SEQ ID NO: 1761 |
| 441_KC | LAEAKEAANAELDSY-GKSDFYKKLIEKAKTVEGVEALKEAILAAC-P | SEQ ID NO: 1762 |
| 441_CC | LAEAKEAANAELDSY-GCSDFYKKLIEKAKTVEGVEALKEAILAAC-P | SEQ ID NO: 1763 |
| 441_KK | LAEAKEAANAELDSY-GKSDFYKKLIEKAKTVEGVEALKEAILAAK-P | SEQ ID NO: 1764 |
| 442_CK | LAEAKEAANAELDSY-GCSDFYKKLIEKAKTVEGVEALKEEILAAK-P | SEQ ID NO: 1765 |
| 442_KC | LAEAKEAANAELDSY-GKSDFYKKLIEKAKTVEGVEALKEEILAAC-P | SEQ ID NO: 1766 |
| 442_CC | LAEAKEAANAELDSY-GCSDFYKKLIEKAKTVEGVEALKEEILAAC-P | SEQ ID NO: 1767 |
| 442_KK | LAEAKEAANAELDSY-GKSDFYKKLIEKAKTVEGVEALKEEILAAK-P | SEQ ID NO: 1768 |
| PEP18050 | LAEAKEAANAELDSYGVSDFYKRLIDKCKTVEGVEALKDAILAALP | SEQ ID NO: 1769 |
| PEP18051 | CAEAKEAANAELDSYGVSDFYKRLIDKAKTVEGVEALKDAILAALP | SEQ ID NO: 1770 |
| PEP18052 | LAEAKEAANAELDSYGCSDFYKRLIDKCKTVEGVEALKDAILAAKP | SEQ ID NO: 1771 |
| PEP18053 | CAEAKEAANAELDSYGCSDFYKRLIDKAKTVEGVEALKDAILAAKP | SEQ ID NO: 1772 |

Figure 1QQQ

| Designation | Amino acid sequence | SEQ ID NO |
|---|---|---|
| PEP14789 | GSSLAEAKEAANAELDSYGCSDFYKRLIDKAKTVEGVEALKDAILAACP | SEQ ID NO: 1773 |
| PEP07830 | LAEAKEAANAELDSYGVSDFYKRLIDKAKTVEGVEALKDAILAALP | SEQ ID NO: 1774 |
| 449 | EXXXAXXEIXXLPNLTXXQXXAFIXKLXDDPSQSSELLSEAKKLNDSQ | SEQ ID NO: 1775 |
| 450 | VDNKFNKEXXXAXXEIXXLPNLNXXQXXAFIXSLXDDPSQSANLLAEAKKLNDAQAPK | SEQ ID NO: 1776 |
| 451 | EXXXAXXEIXXLPNLTXXQXXAFIXKLXDDPSQSSELLSEAKKLSESQ | SEQ ID NO: 1777 |
| 452 | EXXXAXXEIXXLPNLTXXQXXAFIXKLXDDPSQSSELLSEAKKLESSQ | SEQ ID NO: 1778 |
| 453 | EXXXAXXEIXXLPNLTXXQXXAFIXKLXRQPEQSSELLSEAKKLNDSQ | SEQ ID NO: 1779 |
| 454 | EXXXAXXEIXXLPNLTXXQXXAFIXKLXRQPEQSSELLSEAKKLSESQ | SEQ ID NO: 1780 |
| 455 | EXXXAXXEIXXLPNLTXXQXXAFIXKLXRQPEQSSELLSEAKKLESSQ | SEQ ID NO: 1781 |

ENGINEERED ALBUMIN BINDING POLYPEPTIDE

CROSS-REFERENCE TO RELATED APPLICATIONS

This application is a U.S. National Stage Application of PCT/EP2014/078756 filed Dec. 19, 2014 which claims priority to EP Application No. 13198808.1 filed Dec. 20, 2013, both of which are incorporated by reference in their entireties.

TECHNICAL FIELD

The present disclosure relates to a class of engineered polypeptides having a binding affinity for albumin. In particular, the present disclosure relates to albumin binding polypeptides which have a high resistance to enzymatic cleavage and the therapeutic use thereof.

BACKGROUND

Serum Albumin

Serum albumin is the most abundant protein in mammalian sera (35-50 g/l, i.e. 0.53-0.75 mM, in humans), and one of its functions is to bind molecules such as lipids and bilirubin (Peters T, Advances in Protein Chemistry 37:161, 1985). The half-life of serum albumin is directly proportional to the size of the animal, where for example human serum albumin (HSA) has a half-life of 19 days and rabbit serum albumin has a half-life of about 5 days (McCurdy T R et al, J Lab Clin Med 143:115, 2004). Human serum albumin is widely distributed throughout the body, in particular in the intestinal and blood compartments, where it is mainly involved in the maintenance of osmolarity. Structurally, albumins are single-chain proteins comprising three homologous domains and totaling 584 or 585 amino acids (Dugaiczyk L et al, Proc Natl Acad Sci USA 79:71, 1982). Albumins contain 17 disulfide bridges and a single reactive thiol, C34, but lack N-linked and O-linked carbohydrate moieties (Peters, 1985, supra; Nicholson J P et al, Br J Anaesth 85:599, 2000). The lack of glycosylation simplifies recombinant expression of albumin. This property of albumin, together with the fact that its three-dimensional structure is known (He X M and Carter D C, Nature 358:209 1992), has made it an attractive candidate for use in recombinant fusion proteins. Such fusion proteins generally combine a therapeutic protein (which would be rapidly cleared from the body upon administration of the protein per se) and a plasma protein (which exhibits a natural slow clearance) in a single polypeptide chain (Sheffield W P, Curr Drug Targets Cardiovacs Haematol Disord 1:1, 2001). Such fusion proteins may provide clinical benefits in requiring less frequent injection and higher levels of therapeutic protein in vivo.

Fusion or Association with HSA Results in Increased In Vivo Half-Life of Proteins Serum albumin is devoid of any enzymatic or immunological function and, thus, should not exhibit undesired side effects upon coupling to a bioactive polypeptide. Furthermore, HSA is a natural carrier involved in the endogenous transport and delivery of numerous natural as well as therapeutic molecules (Sellers E M and Koch-Weser M D, "Albumin Structure, Function and Uses", eds Rosenoer V M et al, Pergamon, Oxford, p 159, 1977). Several strategies have been reported to either covalently couple proteins directly to serum albumins or to a peptide or protein that will allow in vivo association to serum albumins. Examples of the latter approach have been described e.g. in WO91/01743. This document describes inter alia the use of albumin binding peptides or proteins derived from streptococcal protein G for increasing the half-life of other proteins. The idea is to fuse the bacterially derived, albumin binding peptide/protein to a therapeutically interesting peptide/protein, which has been shown to have a rapid clearance in blood. The thus generated fusion protein binds to serum albumin in vivo, and benefits from its longer half-life, which increases the net half-life of the fused therapeutically interesting peptide/protein.

Association with HSA Results in Decreased Immunogenicity

In addition to the effect on the in vivo half-life of a biologically active protein, it has been proposed that the non-covalent association with albumin of a fusion between a biologically active protein and an albumin binding protein acts to reduce the immune response to the biologically active protein. Thus, in WO2005/097202, there is described the use of this principle to reduce or eliminate the immune response to a biologically active protein.

Albumin Binding Domains of Bacterial Receptor Proteins

Streptococcal protein G is a bi-functional receptor present on the surface of certain strains of streptococci and capable of binding to both IgG and serum albumin (Björck et al, Mol Immunol 24:1113, 1987). The structure is highly repetitive with several structurally and functionally different domains (Guss et al, EMBO J 5:1567, 1986), more precisely three Ig-binding motifs and three serum albumin binding domains (Olsson et al, Eur J Biochem 168:319, 1987). The structure of one of the three serum albumin binding domains has been determined, showing a three-helix bundle domain (Kraulis et al, FEBS Lett 378:190, 1996). This motif was named ABD (albumin binding domain) and is 46 amino acid residues in size. In the literature, it has subsequently also been designated G148-GA3.

Other bacterial albumin binding proteins than protein G from *Streptococcus* have also been identified, which contain domains similar to the albumin binding three-helix domains of protein G. Examples of such proteins are the PAB, PPL, MAG and ZAG proteins. Studies of structure and function of such albumin binding proteins have been carried out and reported e.g. by Johansson and co-workers (Johansson et al, J Mol Biol 266:859-865, 1997; Johansson et al, J Biol Chem 277:8114-8120, 2002), who introduced the designation "GA module" (protein G-related albumin binding module) for the three-helix protein domain responsible for albumin binding. Furthermore, Rozak et al have reported on the creation of artificial variants of the GA module, which were selected and studied with regard to different species specificity and stability (Rozak et al, Biochemistry 45:3263-3271, 2006; He et al, Protein Science 16:1490-1494, 2007). In the present disclosure, the terminology with regard to GA modules from different bacterial species established in the articles by Johansson et al and by Rozak et al will be followed.

Recently, variants of the G148-GA3 domain have been developed, with various optimized characteristics. Such variants are for example disclosed in PCT publications WO2009/016043, WO2012/004384 and WO2014/048977.

Oral Delivery of Protein Therapeutics

The majority of protein and peptide therapeutics currently on the market are administered by the parenteral route, i.e. without passing the gastrointestinal tract, such as by intravenous, intramuscular or subcutaneous injections. Intravenous administration directly into the systemic circulation provides 100% bioavailability and fast onset of drug action. However, the instant high concentration of the drug in the blood increases the risk of side effects. Furthermore, administration by any injection method is associated with low patient compliance due to the pain and discomfort. Self-administration is often not possible and hence treatment has to be carried out in the clinic. The latter becomes a particular problem if the half-life of the drug is short, and frequent, repeated administrations are required to maintain adequate levels of therapeutic action. Clinical treatment, and in some cases necessary hospitalization of the patient, also implies increased costs for society. Simplified administration is thus a major driving force for development of drugs intended for alternative delivery routes such as oral, intranasal, pulmonary, transdermal or rectal, each of which is associated with specific advantages and limitations. Oral administration remains one of the most convenient administration routes, in particular for the treatment of pediatric patients. Furthermore, oral formulations do not require production under sterile conditions, which reduces the manufacturing costs per unit of drug (Salama et al, Adv Drug Deliv Rev. 58:15-28, 2006). For some protein therapeutics, the oral delivery route may even be more physiological, as has been suggested for insulin (Hoffman and Ziv, Clin Pharmacokinet. 33:285-301, 1997).

Oral delivery of conventional low molecular weight drugs has been well established in practice. However, oral delivery of larger, less stable and often polar, peptide and protein therapeutics faces other challenges including that the drug must 1) be resistant to the acidic environment of the stomach 2) be resistant to enzymatic degradation in the gastrointestinal tract and 3) be able to cross the intestinal epithelium and reach into the circulation. Different approaches have been attempted to address these challenges either by modifying the protein itself, or by optimizing the formulation or drug carrier system.

Factors Influencing Oral Bioavailability

Bioavailability refers to the fraction of an administered dose of an active drug substance that reaches the systemic circulation. By definition, the bioavailability of an intravenously administered drug is 100%. However, when the drug is administered via other routes, for instance by the oral route, the bioavailability decreases due to metabolism and incomplete absorbance.

The bioavailability of a protein therapeutic administered orally depends on the physiological properties of the protein, such as molecular weight, amino acid sequence, hydrophobicity, isoelectric point (pi), solubility and pH stability, as well as on the biological barriers encountered in the gastrointestinal tract, i.e. the proteolytic environment and the generally poor absorption of large molecules through the intestinal wall.

The physiochemical environment of the gastrointestinal tract varies depending on the feeding status of the individual. Factors that vary between the fasted and fed stages include pH, the composition of gastrointestinal fluids and the volume of the stomach. In humans, the pH of the stomach is around 1-2 in the fed state whereas it rises to 3-7 in the fasted state. The pH varies throughout the small intestine, but averages around pH 5 and 6.5 in the fed and fasted state, respectively (Klein, AAPS J. 12:397-406, 2010). The differences in pH affect the level of activity of proteolytic enzymes, which are each associated with a specific pH optimum. Pepsin, the predominant protease in the stomach, has optimal activity around pH 2, whereas trypsin and chymotrypsin of the intestine has optimal activity around pH 8. Furthermore, gastric emptying is a rate-limiting step. Food, in particular fatty food, slows gastric emptying and hence the rate of drug absorption (Singh, Clin Pharmacokinet. 37:213-55, 1999), and thus prolongs the time during which the drug is exposed to proteolytic enzymes. Therefore, the bioavailability of the drug can be affected if the drug is taken during or in between meals, with or without a significant of volume liquid, or different types of liquid.

Poor absorption through the intestinal wall remains the main factor limiting the bioavailability of orally delivered protein therapeutics. Drugs taken orally have, as with any nutrient, two options to cross the intestinal wall; by using either the transcellular pathway, which involves passage across cells, or the paracellular pathway, which involves passage between adjacent cells via tight junctions. Molecules with a molecular weight of less than 500 Da can cross using either pathway (Müller, Curr Issues Mol Biol 13:13-24, 2011). The ability of drugs with a larger molecular weight to cross the intestinal wall depends on the physiochemical properties of the drug, such as charge, lipophilicity and hydrophilicity. For lipophilic drugs, the transcellular route dominates, whereas hydrophilic drugs can cross by the paracellular route (Salama et al, 2006, supra). However, the dimension of the paracellular space is between 10 and 30-50 Å, and it has been suggested that the paracellular transport is generally limited to molecules with a radius less than 15 Å (~3.5 kDa) (Rubas et al, J Pharm Sci. 85:165-9, 1996). As for the transcellular pathway, substances with a small molecular weight readily cross by passive diffusion. However, substances having a larger molecular weight are confined to active processes requiring energy expenditure, such as pinocytocis (nonspecific "cell drinking") or transcytosis (receptor-mediated transport).

Finally, bioavailability is also influenced by interpatient variability, including age (drugs are generally metabolized more slowly in fetal, neonatal and geriatric populations), health of the gastrointestinal tract, and general disease state (e.g. hepatic insufficiency, poor renal function), as well as intrapatient variability, i.e. variability in the same patient over time.

Increasing the bioavailability of orally administered proteins and peptides is crucial for enabling delivery of a therapeutically effective dose, reducing the manufacturing costs and to a lesser extent reducing the effect of interpatient and intrapatient variability. Strategies to improve the oral bioavailability of protein therapeutics have ranged from changing physiochemical properties such as hydrophobicity, charge, pH stability and solubility; inclusion of protease inhibitors or absorbance enhancers in the drug formulation; and use of formulation vehicles such as emulsions, liposomes, microspheres or nanoparticles (reviewed in Park et al, Reactive and Functional Polymers, 71:280-287, 2011).

Protein Engineering for Increased In Vivo Stability

Small robust proteins can potentially be engineered to withstand the rough conditions in the gastrointestinal tract and be small enough to be absorbed into the bloodstream. Naturally occurring, stable proteins such as cyclotides and cysteine knot mini-proteins have been studied and engineered (Craik et al, The Journal of Organic Chemistry, 76:4805, 2011 and Werle et al, Journal of Drug Targeting 14:137, 2006). These naturally occurring proteins are cyclic, which is a feature also shared by the peptide hormones oxytocin and somatostatin.

Stabilization of peptides and proteins by the introduction of thioether bridges in proteins naturally devoid of an intra-molecular crosslink has been tested (Rink et al, Journal of Pharmacological and Toxicological Methods, 61:210, 2010 and Kluskens et al, The Journal of Pharmacology and Experimental Therapeutics, 328: 849, 2009).

In summary, considering the relatively low bioavailability of orally administered peptide and protein drugs, it is highly relevant to both reduce the amount that is degraded by gastrointestinal proteases and maintain a long in vivo plasma half-life of the fraction of the drug which crosses the intestinal epithelial membrane in a biologically active form.

As is evident from the background description above, there is a need for the provision of therapeutically effective biopharmaceuticals which can for example be administered via the oral route.

DISCLOSURE OF THE INVENTION

It is an object of the present disclosure to provide new albumin binding molecules, which could be used in therapeutic applications.

It is another object of the present disclosure to provide a molecule allowing for efficient therapy while alleviating the above mentioned and other drawbacks of current therapies.

It is furthermore an object of the present disclosure to provide a molecule suitable for oral delivery.

Another object of the present disclosure is to provide a molecule with a high resistance to proteolytic cleavage.

These and other objects, which are evident to the skilled person from the present disclosure, are met by different aspects of the invention as claimed in the appended claims and as generally disclosed herein.

In a first aspect, the disclosure provides an albumin binding polypeptide comprising an albumin binding motif [ABM], which motif consists of the amino acid sequence (SEQ ID NO. 1782)
$GX_A SDX_5 YKX_8 X_9 I\ X_{11}X_{12}AX_{14}TVEGVX_{20}\ ALX_{23}X_{24}X_{25}ILX_{28}X_{29}X_B$ wherein, independently from each other,
$X_A$ is selected from C and K;
$X_B$ is selected from C and K;
and
$X_5$ is selected from F and Y;
$X_5$ is selected from D, K, N, R and S;
$X_9$ is selected from F, I, L, M, V and Y;
$X_{11}$ is selected from D, E, N and S;
$X_{12}$ is selected from K, N and R;
$X_{14}$ is selected from K and R;
$X_{20}$ is selected from D, E, H, K, N, Q, R and S;
$X_{23}$ is selected from I, K and T;
$X_{24}$ is selected from A, D, E, G, H, L, S and T;
$X_{25}$ is selected from A, D, E and H;
$X_{28}$ is selected from A and K; and
$X_{29}$ is selected from A, E and S.
In one embodiment, $X_A$ is C.
In another embodiment, $X_A$ is K.
In one embodiment, $X_B$ is C.
In another embodiment, $X_B$ is K.
In other words, $X_A X_B$ is selected from CK, KC, CC and KK, for example selected from CK, KC and CC, such as selected from CK and CC. Thus, in one specific embodiment, $X_A X_B$ is CK. In another specific embodiment, $X_A X_B$ is CC. In yet another specific embodiment, $X_A X_B$ is KC. In another specific embodiment, $X_A X_B$ is KK.

In order to provide albumin binding polypeptides which are suitable to therapeutic applications, such as albumin binding polypeptides that are suitable for oral delivery and exhibit high resistant to proteolytic cleavage, such as cleavage by gastrointestinal proteases for example pepsin, trypsin and chymotrypsin, the inventors have studied variants of PEP07830 (SEQ ID NO:1774). For example, the inventors show that a crosslink between residue $X_A$, corresponding to position 2 in the above mentioned sequence, and residue $X_B$, corresponding to position 30 in the above mentioned sequence, leads to an improved protease stability while albumin binding ability is retained, in contrast to other tested crosslinked variants (as described in Examples 4 and 5 below).

The albumin binding motif, or ABM, corresponds to the albumin binding region of the G148-GA3, which region constitutes two alpha helices within a three-helical bundle protein domain. It is known that the original amino acid residues of said two alpha helices in the parent scaffold constitute a binding surface for interaction with albumin.

As the skilled person will realize, the function of any polypeptide, such as the albumin binding capacity of the polypeptides according to the present disclosure, is dependent on the tertiary structure of said polypeptide. It is therefore generally possible to make minor changes to the sequence of amino acids in a polypeptide without affecting the function thereof. For example, it is possible that an amino acid residue belonging to a certain functional group of amino acid residues (e.g. hydrophobic, hydrophilic, polar etc) could be exchanged for another amino acid residue from the same functional group.

Thus, the present disclosure encompasses variants of originally described or naturally occurring albumin binding polypeptides, which are such that the albumin binding characteristics are retained. For example, the present disclosure encompasses modified variants of albumin binding polypeptides previously described in PCT publications WO2009/016043, WO2012/004384 and WO2014/048977; it is contemplated that the modifications described herein make these previously described albumin binders more useful in the various applications referred to in the background section above. A skilled person would appreciate that said modifications are equally applicable to any albumin binding polypeptide based on the G148-GA3 scaffold, as such modifications do not alter the three dimensional conformation required for interaction with albumin.

Hence, the present disclosure encompasses ABMs comprising substitution mutations that do not significantly diminish albumin binding characteristics, while simultaneously confer improved properties upon said ABM which render it more useful for therapeutic applications, such as treatment via oral administration.

In one embodiment, $X_5$ is F.
In one embodiment, $X_5$ is Y.
In one embodiment, $X_5$ is selected from K, N, R and S.
In one embodiment, $X_5$ is selected from N, R and S.
In one embodiment, $X_5$ is selected from K, N and R.
In one embodiment, $X_5$ is selected from N and R.
In one embodiment, $X_5$ is selected from K and R.
In one embodiment, $X_5$ is R.
In one embodiment, $X_5$ is N.
In one embodiment, $X_8$ is K.
In one embodiment, $X_9$ is L.
In one embodiment, $X_{11}$ is selected from D, E and N.
In one embodiment, $X_{11}$ is selected from N and S.
In one embodiment, $X_{11}$ is N.
In one embodiment, $X_{11}$ is selected from D and E.
In one embodiment, $X_{11}$ is D.
In one embodiment, $X_{11}$ is E.
In one embodiment, $X_{12}$ is selected from K and N.
In one embodiment, $X_{12}$ is selected from K and R.
In one embodiment, $X_{12}$ is K.
In one embodiment, $X_{12}$ is N.

In one embodiment, $X_{12}$ is R.
In one embodiment, $X_{14}$ is K.
In one embodiment, $X_{20}$ is selected from D, E, H, N, Q, R and S.
In one embodiment, $X_{20}$ is selected from K and E.
In one embodiment, $X_{20}$ is E.
In one embodiment, $X_{20}$ is K.
In one embodiment, $X_{23}$ is selected from I and K.
In one embodiment, $X_{23}$ is I.
In one embodiment, $X_{23}$ is K.
In one embodiment, $X_{24}$ is selected from A, D, G, H, L, S and T.
In one embodiment, $X_{24}$ is selected from A, E, G, H, L, S and T.
In one embodiment, $X_{24}$ is selected from A, G, H, L, S and T.
In one embodiment, $X_{24}$ is selected from D, E and L.
In one embodiment, $X_{24}$ is selected from D and E.
In one embodiment, $X_{24}$ is L.
In one embodiment, $X_{24}$ is D.
In one embodiment, $X_{24}$ is E.
In one embodiment, $X_{25}$ is selected from A, E and H.
In one embodiment, $X_{25}$ is selected from A and H.
In one embodiment, $X_{25}$ is selected from A and E.
In one embodiment, $X_{25}$ is selected from D, E and H.
In one embodiment, $X_{25}$ is selected from D and E.
In one embodiment, $X_{25}$ is E.
In one embodiment, $X_{25}$ is A.
In one embodiment, $X_{25}$ is D.
In one embodiment, $X_{25}$ is H.
In one embodiment, $X_{28}$ is A.
In one embodiment, $X_{29}$ is selected from A and S.
In one embodiment, $X_{29}$ is A.
In one embodiment, $X_{29}$ is S.
In one embodiment, the ABM comprises an additional position $X_{31}$ located on the C-terminal side of the core sequence disclosed above. In one embodiment, the amino acid residue at position $X_{31}$ is P.

As stated above, the substitution mutations designated $X_A$ and $X_B$ may be introduced into the sequences of albumin binding polypeptides previously described in PCT publications WO2009/016043, WO2012/004384 and WO2014/048977. Taking the disclosure in these PCT applications of individual albumin binding motifs into account, and considering the experimental proof of correct functioning given in the experimental section to follow, the skilled person is in a position to visualize a substantial number of individual albumin binding motif (ABM) sequences. These sequences comprise the "crosslinking mutations" in positions $X_A$ and $X_B$ and constitute individual embodiments of the ABM sequence in the definition of albumin binding polypeptides according to this aspect of the present disclosure. The sequences of individual albumin binding polypeptides, from which individual albumin binding motifs may be deduced, are presented in FIG. 1 and denoted SEQ ID NO:1-1768.

Thus, in one embodiment of the albumin binding polypeptide according to the invention, the ABM consists of an amino acid sequence extending from position 16 to position 45 in an amino acid sequence selected from the group consisting of SEQ ID NO:1-1768.

In one embodiment, $X_A$ is C and $X_B$ is C or K, so the ABM consists of an amino acid sequence extending from position 16 to position 45 in an amino acid sequence selected from the group consisting of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765 and 1767.

In another embodiment, $X_A$ is C and $X_B$ is K, so the ABM consists of an amino acid sequence extending from position 16 to position 45 in an amino acid sequence selected from the group consisting of SEQ ID NO:1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, 433, 437, 441, 445, 449, 453, 457, 461, 465, 469, 473, 477, 481, 485, 489, 493, 497, 501, 505, 509, 513, 517, 521, 525, 529, 533, 537, 541, 545, 549, 553, 557, 561, 565, 569, 573, 577, 581, 585, 589, 593, 597, 601, 605, 609, 613, 617, 621, 625, 629, 633, 637, 641, 645, 649, 653, 657, 661, 665, 669, 673, 677, 681, 685, 689, 693, 697, 701, 705, 709, 713, 717, 721, 725, 729, 733, 737, 741, 745, 749, 753, 757, 761, 765, 769, 773, 777, 781, 785, 789, 793, 797, 801, 805, 809, 813, 817, 821, 825, 829, 833, 837, 841, 845, 849, 853, 857, 861, 865, 869, 873, 877, 881, 885, 889, 893, 897, 901, 905, 909, 913, 917, 921, 925, 929, 933, 937, 941, 945, 949, 953, 957, 961, 965, 969, 973, 977, 981, 985, 989, 993, 997, 1001, 1005, 1009, 1013, 1017, 1021, 1025, 1029, 1033, 1037, 1041, 1045, 1049, 1053, 1057, 1061, 1065, 1069, 1073, 1077, 1081, 1085, 1089, 1093, 1097, 1101, 1105, 1109, 1113, 1117, 1121, 1125, 1129, 1133, 1137, 1141, 1145, 1149, 1153, 1157, 1161, 1165, 1169, 1173, 1177, 1181, 1185, 1189, 1193, 1197, 1201, 1205, 1209, 1213, 1217, 1221, 1225, 1229, 1233, 1237, 1241, 1245, 1249, 1253, 1257, 1261, 1265, 1269, 1273, 1277, 1281, 1285, 1289, 1293, 1297, 1301, 1305, 1309, 1313, 1317, 1321, 1325, 1329, 1333, 1337, 1341, 1345, 1349, 1353, 1357, 1361, 1365, 1369, 1373, 1377, 1381, 1385, 1389, 1393, 1397, 1401, 1405, 1409, 1413, 1417, 1421, 1425, 1429, 1433, 1437, 1441, 1445, 1449, 1453, 1457, 1461, 1465, 1469, 1473, 1477, 1481, 1485, 1489, 1493, 1497, 1501, 1505, 1509, 1513, 1517, 1521, 1525, 1529, 1533, 1537, 1541, 1545, 1549, 1553, 1557, 1561, 1565, 1569, 1573, 1577, 1581, 1585, 1589, 1593, 1597, 1601, 1605, 1609, 1613, 1617, 1621, 1625, 1629, 1633, 1637, 1641, 1645, 1649, 1653, 1657, 1661, 1665, 1669, 1673, 1677, 1681, 1685, 1689, 1693, 1697, 1701, 1705, 1709, 1713, 1717, 1721, 1725, 1729, 1733, 1737, 1741, 1745, 1749, 1753, 1757, 1761 and 1765.

In another embodiment, the ABM sequence is one of the sequences listed in PCT publication WO2009/016043, mutated as described herein through substitution in the $X_A$ and $X_B$ positions. Thus, in this embodiment, the ABM consists of an amino acid sequence extending from position 16 to position 45 in an amino acid sequence selected from the group consisting of SEQ ID NO:5-1004.

In another embodiment, $X_A$ is C and $X_B$ is C or K in these sequences from WO2009/016043, so the ABM consists of an amino acid sequence extending from position 16 to position 45 in an amino acid sequence selected from the group consisting of SEQ ID NO:5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001 and 1003.

In another embodiment, $X_A$ is C and $X_B$ is K in these sequences from WO2009/016043, so the ABM consists of an amino acid sequence extending from position 16 to position 45 in an amino acid sequence selected from the group consisting of SEQ ID NO:5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, 433, 437, 441, 445, 449, 453, 457, 461, 465, 469, 473, 477, 481, 485, 489, 493, 497, 501, 505, 509, 513, 517, 521, 525, 529, 533, 537, 541, 545, 549, 553, 557, 561, 565, 569, 573, 577, 581, 585, 589, 593, 597, 601, 605, 609, 613, 617, 621, 625, 629, 633, 637, 641, 645, 649, 653, 657, 661, 665, 669, 673, 677, 681, 685, 689, 693, 697, 701, 705, 709, 713, 717, 721, 725, 729, 733, 737, 741, 745, 749, 753, 757, 761, 765, 769, 773, 777, 781, 785, 789, 793, 797, 801, 805, 809, 813, 817, 821, 825, 829, 833, 837, 841, 845, 849, 853, 857, 861, 865, 869, 873, 877, 881, 885, 889, 893, 897, 901, 905, 909, 913, 917, 921, 925, 929, 933, 937, 941, 945, 949, 953, 957, 961, 965, 969, 973, 977, 981, 985, 989, 993, 997 and 1001.

In another embodiment, the ABM sequence is a mutated version of any one of the albumin binding motif sequences disclosed in claim 24 of WO2009/016043. Thus, in this embodiment, the ABM consists of an amino acid sequence extending from position 16 to position 45 in an amino acid sequence selected from the group consisting of SEQ ID NO:9-12, 13-16, 37-40, 61-64, 101-104, 109-112, 185-188, 197-200, 213-216, 217-220, 221-224, 617-620, 925-928, 929-932, 933-936, 937-940, 941-944, 945-948 and 949-952.

In another embodiment, $X_A$ is C and $X_B$ is C or K in these sequences from claim 24 of WO2009/016043, so the ABM consists of an amino acid sequence extending from position 16 to position 45 in an amino acid sequence selected from the group consisting of SEQ ID NO: 9, 11, 13, 15, 37, 39, 61, 63, 101, 103, 109, 111, 185, 187, 197, 199, 213, 215, 217, 219, 221, 223, 617, 619, 925, 927, 929, 931, 933, 935, 937, 939, 941, 943, 945, 947, 949 and 951.

In another embodiment, $X_A$ is C and $X_B$ is K in these sequences from claim 24 of WO2009/016043, so the ABM consists of an amino acid sequence extending from position 16 to position 45 in an amino acid sequence selected from the group consisting of SEQ ID NO:9, 13, 37, 61, 101, 109, 185, 197, 213, 217, 221, 617, 925, 929, 933, 937, 941, 945 and 949.

In another embodiment, the ABM sequence is a mutated version of any one of the albumin binding motif sequences disclosed in claim 25 of WO2009/016043. Thus, in this embodiment, the ABM consists of an amino acid sequence extending from position 16 to position 45 in an amino acid sequence selected from the group consisting of SEQ ID NO:9-12, 213-216 and 925-928.

In another embodiment, $X_A$ is C and $X_B$ is C or K in these sequences from claim 25 of WO2009/016043, so the ABM consists of an amino acid sequence extending from position 16 to position 45 in an amino acid sequence selected from the group consisting of SEQ ID NO:9, 11, 213, 215, 925 and 927.

In another embodiment, $X_A$ is C and $X_B$ is K in these sequences from claim 25 of WO2009/016043, so the ABM consists of an amino acid sequence extending from position 16 to position 45 in an amino acid sequence selected from the group consisting of SEQ ID NO:9, 213 and 925, such as SEQ ID NO:925.

In another embodiment, the ABM sequence is one of the sequences listed in PCT publication WO2012/004384, mutated as described herein through substitution in the $X_A$ and $X_B$ positions. Thus, in this embodiment, the ABM consists of an amino acid sequence extending from position 16 to position 45 in an amino acid sequence selected from the group consisting of SEQ ID NO:1-4 and 1005-1736. In another embodiment, the ABM sequence consists of an amino acid sequence extending from position 16 to position 45 in an amino acid sequence selected from SEQ ID NO:1-4.

In another embodiment, $X_A$ is C and $X_B$ is C or K in these sequences from WO2012/004384, so the ABM consists of an amino acid sequence extending from position 16 to position 45 in an amino acid sequence selected from the group consisting of SEQ ID NO:1, 3, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733 and 1735.

In another embodiment, $X_A$ is C and $X_B$ is K in these sequences from WO2012/004384, so the ABM consists of an amino acid sequence extending from position 16 to position 45 in an amino acid sequence selected from the group consisting of SEQ ID NO:1, 1005, 1009, 1013, 1017, 1021, 1025, 1029, 1033, 1037, 1041, 1045, 1049, 1053, 1057, 1061, 1065, 1069, 1073, 1077, 1081, 1085, 1089, 1093, 1097, 1101, 1105, 1109, 1113, 1117, 1121, 1125, 1129, 1133, 1137, 1141, 1145, 1149, 1153, 1157, 1161, 1165, 1169, 1173, 1177, 1181, 1185, 1189, 1193, 1197, 1201, 1205, 1209, 1213, 1217, 1221, 1225, 1229, 1233, 1237, 1241, 1245, 1249, 1253, 1257, 1261, 1265, 1269, 1273, 1277, 1281, 1285, 1289, 1293, 1297, 1301, 1305, 1309, 1313, 1317, 1321, 1325, 1329, 1333, 1337, 1341, 1345, 1349, 1353, 1357, 1361, 1365, 1369, 1373, 1377, 1381, 1385, 1389, 1393, 1397, 1401, 1405, 1409, 1413, 1417, 1421, 1425, 1429, 1433, 1437, 1441, 1445, 1449, 1453, 1457, 1461, 1465, 1469, 1473, 1477, 1481, 1485, 1489, 1493, 1497, 1501, 1505, 1509, 1513, 1517, 1521, 1525, 1529, 1533, 1537, 1541, 1545, 1549, 1553, 1557, 1561, 1565, 1569, 1573, 1577, 1581, 1585, 1589, 1593, 1597, 1601, 1605, 1609, 1613, 1617, 1621, 1625, 1629, 1633, 1637, 1641, 1645, 1649, 1653, 1657, 1661, 1665, 1669, 1673, 1677, 1681, 1685, 1689, 1693, 1697, 1701, 1705, 1709, 1713, 1717, 1721, 1725, 1729 and 1733.

In another embodiment, the ABM sequence is a mutated version of the albumin binding motif in any one of the amino acid sequences disclosed in claim 23 of WO2012/004384. Thus, in this embodiment, the ABM consists of an amino acid sequence extending from position 16 to position 45 in an amino acid sequence selected from the group consisting of SEQ ID NO:1-4, 1017-1020, 1021-1024, 1029-1032, 1033-1036, 1041-1044, 1045-1048, 1053-1056, 1061-1064, 1065-1068, 1073-1076, 1077-1080, 1085-1088, 1089-1092, 1097-1100, 1101-1104, 1109-1112, 1113-1116, 1121-1124, 1125-1128, 1133-1136, 1137-1140, 1145-1148, 1149-1152, 1161-1164, 1165-1168, 1193-1196, 1197-1200, 1577-1580, 1581-1584, 1585-1588, 1589-1592, 1593-1596, 1597-1600, 1601-1604, 1689-1692, 1693-1696, 1697-1700, 1701-1704, 1705-1708, 1709-1712, 1713-1716, 1717-1720, 1721-1724, 1725-1728, 1729-1732 and 1733-1736.

In another embodiment, $X_A$ is C and $X_B$ is C or K in these sequences from claim 23 of WO2012/004384, so the ABM consists of an amino acid sequence extending from position 16 to position 45 in an amino acid sequence selected from the group consisting of SEQ ID NO:1, 3, 1017, 1019, 1021, 1023, 1029, 1031, 1033, 1035, 1041, 1043, 1045, 1047, 1053, 1055, 1061, 1063, 1065, 1067, 1073, 1075, 1077, 1079, 1085, 1087, 1089, 1091, 1097, 1099, 1101, 1103, 1109, 1111, 1113, 1115, 1121, 1123, 1125, 1127, 1133, 1135, 1137, 1139, 1145, 1147, 1149, 1151, 1161, 1163, 1165, 1167, 1193, 1195, 1197, 1199, 1577, 1579, 1581, 1583, 1585, 1587, 1589, 1591, 1593, 1595, 1597, 1599, 1601, 1603, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733 and 1735.

In another embodiment, $X_A$ is C and $X_B$ is K in these sequences from claim 23 of WO2012/004384, so the ABM consists of an amino acid sequence extending from position 16 to position 45 in an amino acid sequence selected from the group consisting of SEQ ID NO:1, 1017, 1021, 1029, 1033, 1041, 1045, 1053, 1061, 1065, 1073, 1077, 1085, 1089, 1097, 1101, 1109, 1113, 1121, 1125, 1133, 1137, 1145, 1149, 1161, 1165, 1193, 1197, 1577, 1581, 1585, 1589, 1593, 1597, 1601, 1689, 1693, 1697, 1701, 1705, 1709, 1713, 1717, 1721, 1725, 1729 and 1733.

In another embodiment, the ABM sequence is one of the sequences listed in PCT publication WO2014/048977, mutated as described herein through substitution in the $X_A$ and $X_B$ positions. Thus, in this embodiment, the ABM consists of an amino acid sequence extending from position 16 to position 45 in an amino acid sequence selected from the group consisting of SEQ ID NO:1737-1768.

In another embodiment, $X_A$ is C and $X_B$ is C or K in these sequences from PCT publication WO2014/048977, so the ABM consists of an amino acid sequence extending from position 16 to position 45 in an amino acid sequence selected from the group consisting of SEQ ID NO: 1737, 1739, 1741, 1743, 1745, 1747, 1749, 1751, 1753, 1755, 1757, 1759, 1761, 1763, 1765 and 1767.

In another embodiment, $X_A$ is C and $X_B$ is K in these sequences from PCT publication WO2014/048977, so the ABM consists of an amino acid sequence extending from position 16 to position 45 in an amino acid sequence selected from the group consisting of SEQ ID NO: 1737, 1741, 1745, 1749, 1753, 1757, 1761 and 1765.

In another embodiment, the ABM sequence is a mutated version of the albumin binding motif sequence disclosed in claim 2 of PCT publication WO2014/048977. Thus, in this embodiment, the ABM consists of an amino acid sequence extending from position 16 to position 45 in an amino acid sequence selected from the group consisting of SEQ ID NO:1737-1740.

In another embodiment, $X_A$ is C and $X_B$ is C or K in this sequence from claim 2 of PCT publication WO2014/048977, so the ABM consists of an amino acid sequence extending from position 16 to position 45 in an amino acid sequence selected from the group consisting of SEQ ID NO: 1737 and 1739.

In another embodiment, $X_A$ is C and $X_B$ is K in this sequence from claim 2 of PCT publication WO2014/048977, so the ABM consists of an amino acid sequence extending from position 16 to position 45 in SEQ ID NO:1737.

In embodiments of the present disclosure, the ABM forms part of a three-helix bundle protein domain. For example, the ABM may essentially constitute, or form part of, two alpha helices with an interconnecting loop, within said three-helix bundle protein domain.

In particular embodiments, the three-helix bundle protein domain is selected from the group consisting of three-helix domains of bacterial receptor proteins. Non-limiting examples of such bacterial receptor proteins are selected from the group consisting of albumin binding receptor proteins from species of *Streptococcus*, *Peptostreptococcus* and *Finegoldia*, such as for example selected from the group consisting of proteins G, MAG, ZAG, PPL and PAB. In a specific embodiment, the ABM forms part of protein G, such as for example protein G from *Streptococcus* strain G148. In different variants of this embodiment, the three-helix bundle protein domain of which the ABM forms a part is selected from the group consisting of domain GA1, domain GA2 and domain GA3 of protein G from *Streptococcus* strain G148, in particular domain GA3.

In alternative embodiments, the ABM forms part of one or more of the five three-helix domains of the bacterial receptor protein A from *Staphylococcus aureus*; i.e. the three-helix bundle protein domain is selected from the group consisting of protein A domains A, B, C, D and E. In other similar embodiments, the ABM forms part of protein Z, derived from domain B of protein A from *Staphylococcus aureus*.

In embodiments of the present aspect wherein the ABM "forms part of" a three-helix bundle protein domain, this is understood to mean that the sequence of the ABM is "inserted" into or "grafted" onto the sequence of the naturally occurring (or otherwise original) three-helix bundle domain, such that the ABM replaces a similar structural motif in the original domain. For example, without wishing to be bound by theory, the ABM is thought to constitute two of the three helices of a three-helix bundle, and can therefore replace such a two-helix motif within any three-helix bundle. As the skilled person will realize, the replacement of two helices of the three-helix bundle domain by the two ABM helices has to be performed so as not to affect the basic structure of the polypeptide. That is, the overall folding of the Ca-backbone of the polypeptide according to this embodiment will be substantially the same as that of the three-helix bundle protein domain of which it forms a part, e.g. having the same elements of secondary structure in the same order etc. Thus, an ABM according to the present disclosure "forms part" of a three-helix bundle domain if the polypeptide according to this embodiment has the same fold as the original domain, implying that the basic structural properties are shared, those properties e.g. resulting in similar CD spectra. The skilled person is aware of other parameters that are relevant.

In one embodiment according to the first aspect of the present disclosure, the albumin binding polypeptide is a three-helix bundle protein domain, which comprises the ABM as defined above and additional sequences making up the remainder of the three-helix configuration. Thus, the present disclosure provides an albumin binding polypeptide, which comprises the amino acid sequence:

(SEQ ID NO. 1783)
LAX$_a$AKX$_b$X$_c$AX$_d$X$_e$ ELX$_f$X$_g$Y-[ABM]

wherein
[ABM] is an albumin binding motif as defined herein, and, independently of each other,
X$_a$ is selected from C, E, Q and S;
X$_b$ is selected from C, E, S and V;
X$_c$ is selected from A, D, E, L and S;

$X_d$ is selected from I, N and L;
$X_e$ is selected from A, K, R and S;
$X_f$ is selected from D and K; and
$X_g$ is selected from A, C, K and S.

In one embodiment, $X_a$ is selected from S and E.
In one embodiment, $X_a$ is S.
In one embodiment, $X_a$ is E.
In one embodiment, $X_b$ is selected from C, E and S.
In one embodiment, $X_b$ is selected from E and V.
In one embodiment, $X_b$ is E.
In one embodiment, $X_b$ is V.
In one embodiment, $X_c$ is selected from A and L.
In one embodiment, $X_c$ is selected from A and S.
In one embodiment, $X_c$ is A.
In one embodiment, $X_c$ is L.
In one embodiment, $X_d$ is N.
In one embodiment, $X_e$ is selected from A and R.
In one embodiment, $X_e$ is selected from A and S.
In one embodiment, $X_e$ is A.
In one embodiment, $X_e$ is R.
In one embodiment, $X_e$ is S.
In one embodiment, $X_f$ is D.
In one embodiment, $X_g$ is selected from C, K and S.
In one embodiment, $X_g$ is selected from K and S.
In one embodiment, $X_g$ is selected from C and S.
In one embodiment, $X_g$ is S.
In one embodiment, $X_g$ is K.
In one embodiment, $X_g$ is C.

Once again, the substitution mutations designated $X_A$ and $X_B$ may be introduced into the sequences of albumin binding polypeptides previously described in PCT publications WO2009/016043, WO2012/004384 and WO2014/048977. In other words, the skilled person may visualize a substantial number of individual albumin binding polypeptides, in which the albumin binding motif as described herein forms a part. These sequences constitute individual embodiments of albumin binding polypeptides according to this aspect. As stated previously, the sequences of individual albumin binding polypeptides are presented in FIG. 1 and denoted SEQ ID NO:1-1768.

Thus, in one embodiment of the albumin binding polypeptide according to the disclosure, it comprises an amino acid sequence selected from the group consisting of SEQ ID NO:1-1768.

In one embodiment, $X_A$ is C and $X_B$ is C or K, so the albumin binding polypeptide comprises an amino acid sequence selected from the group consisting of SEQ ID NO:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733, 1735, 1737, 1739, 1741, 1743, 1745, 1747, 1749, 1751, 1753, 1755, 1757, 1759, 1761, 1763, 1765 and 1767.

In another embodiment, $X_A$ is C and $X_B$ is K, so the albumin binding polypeptide comprises an amino acid sequence selected from the group consisting of SEQ ID NO:1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, 433, 437, 441, 445, 449, 453, 457, 461, 465, 469, 473, 477, 481, 485, 489, 493, 497, 501, 505, 509, 513, 517, 521, 525, 529, 533, 537, 541, 545, 549, 553, 557, 561, 565, 569, 573, 577, 581, 585, 589, 593, 597, 601, 605, 609, 613, 617, 621, 625, 629, 633, 637, 641, 645, 649, 653, 657, 661, 665, 669, 673, 677, 681, 685, 689, 693, 697, 701, 705, 709, 713, 717, 721, 725, 729, 733, 737, 741, 745, 749, 753, 757, 761, 765, 769, 773, 777, 781, 785, 789, 793, 797, 801, 805, 809, 813, 817, 821, 825, 829, 833, 837, 841, 845, 849, 853, 857, 861, 865, 869, 873, 877, 881, 885, 889, 893, 897, 901, 905, 909, 913, 917, 921, 925, 929, 933, 937, 941, 945, 949, 953, 957, 961, 965, 969, 973, 977, 981, 985, 989, 993, 997, 1001, 1005, 1009, 1013, 1017, 1021, 1025, 1029, 1033, 1037, 1041, 1045, 1049, 1053, 1057, 1061, 1065, 1069, 1073, 1077, 1081, 1085, 1089, 1093, 1097, 1101, 1105, 1109, 1113, 1117, 1121, 1125, 1129, 1133, 1137, 1141, 1145, 1149, 1153, 1157, 1161, 1165, 1169, 1173, 1177, 1181, 1185, 1189, 1193, 1197, 1201, 1205, 1209, 1213, 1217, 1221, 1225, 1229, 1233, 1237, 1241, 1245, 1249, 1253, 1257, 1261, 1265, 1269, 1273, 1277, 1281, 1285, 1289, 1293, 1297, 1301, 1305, 1309, 1313, 1317, 1321, 1325, 1329, 1333, 1337, 1341, 1345, 1349, 1353, 1357, 1361, 1365, 1369, 1373, 1377, 1381, 1385, 1389, 1393, 1397, 1401, 1405, 1409, 1413, 1417, 1421, 1425, 1429, 1433, 1437, 1441, 1445, 1449, 1453, 1457, 1461, 1465, 1469, 1473, 1477, 1481, 1485, 1489, 1493, 1497, 1501, 1505, 1509, 1513, 1517, 1521, 1525, 1529, 1533, 1537, 1541, 1545, 1549, 1553, 1557, 1561, 1565, 1569, 1573, 1577, 1581, 1585, 1589, 1593, 1597, 1601, 1605, 1609, 1613, 1617, 1621, 1625, 1629, 1633, 1637, 1641, 1645, 1649, 1653, 1657, 1661, 1665, 1669, 1673, 1677, 1681, 1685, 1689, 1693, 1697, 1701, 1705, 1709, 1713, 1717, 1721, 1725, 1729, 1733, 1737, 1741, 1745, 1749, 1753, 1757, 1761 and 1765.

In another embodiment, the albumin binding polypeptide comprises one of the sequences listed in PCT publication WO2009/016043, mutated as described herein through substitution in the $X_A$ and $X_B$ positions. Thus, in this embodiment, the albumin binding polypeptide comprises an amino acid sequence selected from the group consisting of SEQ ID NO:5-1004.

In another embodiment, $X_A$ is C and $X_B$ is C or K in these sequences from WO2009/016043, so the albumin binding polypeptide comprises an amino acid sequence selected from the group consisting of SEQ ID NO: 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001 and 1003.

In another embodiment, $X_A$ is C and $X_B$ is K in these sequences from WO2009/016043, so the albumin binding polypeptide comprises an amino acid sequence selected from the group consisting of SEQ ID NO:5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213, 217, 221, 225, 229, 233, 237, 241, 245, 249, 253, 257, 261, 265, 269, 273, 277, 281, 285, 289, 293, 297, 301, 305, 309, 313, 317, 321, 325, 329, 333, 337, 341, 345, 349, 353, 357, 361, 365, 369, 373, 377, 381, 385, 389, 393, 397, 401, 405, 409, 413, 417, 421, 425, 429, 433, 437, 441, 445, 449, 453, 457, 461, 465, 469, 473, 477, 481, 485, 489, 493, 497, 501, 505, 509, 513, 517, 521, 525, 529, 533, 537, 541, 545, 549, 553, 557, 561, 565, 569, 573, 577, 581, 585, 589, 593, 597, 601, 605, 609, 613, 617, 621, 625, 629, 633, 637, 641, 645, 649, 653, 657, 661, 665, 669, 673, 677, 681, 685, 689, 693, 697, 701, 705, 709, 713, 717, 721, 725, 729, 733, 737, 741, 745, 749, 753, 757, 761, 765, 769, 773, 777, 781, 785, 789, 793, 797, 801, 805, 809, 813, 817, 821, 825, 829, 833, 837, 841, 845, 849, 853, 857, 861, 865, 869, 873, 877, 881, 885, 889, 893, 897, 901, 905, 909, 913, 917, 921, 925, 929, 933, 937, 941, 945, 949, 953, 957, 961, 965, 969, 973, 977, 981, 985, 989, 993, 997 and 1001.

In another embodiment, the albumin binding polypeptide comprises a mutated version of any one of the albumin binding motif sequences disclosed in claim 24 of WO2009/016043. Thus, in this embodiment, the albumin binding polypeptide comprises an amino acid sequence selected from the group consisting of SEQ ID NO:9-12, 13-16, 37-40, 61-64, 101-104, 109-112, 185-188, 197-200, 213-216, 217-220, 221-224, 617-620, 925-928, 929-932, 933-936, 937-940, 941-944, 945-948 and 949-952.

In another embodiment, $X_A$ is C and $X_B$ is C or K in these sequences from claim 24 of WO2009/016043, so the albumin binding polypeptide comprises an amino acid sequence selected from the group consisting of SEQ ID NO: 9, 11, 13, 15, 37, 39, 61, 63, 101, 103, 109, 111, 185, 187, 197, 199, 213, 215, 217, 219, 221, 223, 617, 619, 925, 927, 929, 931, 933, 935, 937, 939, 941, 943, 945, 947, 949 and 951.

In another embodiment, $X_A$ is C and $X_B$ is K in these sequences from claim 24 of WO2009/016043, so the albumin binding polypeptide comprises an amino acid sequence selected from the group consisting of SEQ ID NO:9, 13, 37, 61, 101, 109, 185, 197, 213, 217, 221, 617, 925, 929, 933, 937, 941, 945 and 949.

In another embodiment the albumin binding polypeptide comprises a mutated version of any one of the albumin binding motif sequences disclosed in claim 25 of WO2009/016043. Thus, in this embodiment, the albumin binding polypeptide comprises an amino acid sequence selected from the group consisting of SEQ ID NO:9-12, 213-216 and 925-928.

In another embodiment, $X_A$ is C and $X_B$ is C or K in these sequences from claim 25 of WO2009/016043, so the albumin binding polypeptide comprises an amino acid sequence selected from the group consisting of SEQ ID NO:9, 11, 213, 215, 925 and 927.

In another embodiment, $X_A$ is C and $X_B$ is K in these sequences from claim 25 of WO2009/016043, so the albumin binding polypeptide comprises an amino acid sequence selected from the group consisting of SEQ ID NO:9, 213 and 925, such as SEQ ID NO:925.

In another embodiment, the albumin binding polypeptide comprises one of the sequences listed in PCT publication WO2012/004384, mutated as described herein through substitution in the $X_A$ and $X_B$ positions. Thus, in this embodiment, the albumin binding polypeptide comprises an amino acid sequence selected from the group consisting of SEQ ID NO:1-4 and 1005-1736. In another embodiment, the albumin binding polypeptide comprises an amino acid sequence selected from SEQ ID NO:1-4.

In another embodiment, $X_A$ is C and $X_B$ is C or K in these sequences from WO2012/004384, so the albumin binding polypeptide comprises an amino acid sequence selected from the group consisting of SEQ ID NO:1, 3, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1083, 1085, 1087, 1089, 1091, 1093, 1095, 1097, 1099, 1101, 1103, 1105, 1107, 1109, 1111, 1113, 1115, 1117, 1119, 1121, 1123, 1125, 1127, 1129, 1131, 1133, 1135, 1137, 1139, 1141, 1143, 1145, 1147, 1149, 1151, 1153, 1155, 1157, 1159, 1161, 1163, 1165, 1167, 1169, 1171, 1173, 1175, 1177, 1179, 1181, 1183, 1185, 1187, 1189, 1191, 1193, 1195, 1197, 1199, 1201, 1203, 1205, 1207, 1209, 1211, 1213, 1215, 1217, 1219, 1221, 1223, 1225, 1227, 1229, 1231, 1233, 1235, 1237, 1239, 1241, 1243, 1245, 1247, 1249, 1251, 1253, 1255, 1257, 1259, 1261, 1263, 1265, 1267, 1269, 1271, 1273, 1275, 1277, 1279, 1281, 1283, 1285, 1287, 1289, 1291, 1293, 1295, 1297, 1299, 1301, 1303, 1305, 1307, 1309, 1311, 1313, 1315, 1317, 1319, 1321, 1323, 1325, 1327, 1329, 1331, 1333, 1335, 1337, 1339, 1341, 1343, 1345, 1347, 1349, 1351, 1353, 1355, 1357, 1359, 1361, 1363, 1365, 1367, 1369, 1371, 1373, 1375, 1377, 1379, 1381, 1383, 1385, 1387, 1389, 1391, 1393, 1395, 1397, 1399, 1401, 1403, 1405, 1407, 1409, 1411, 1413, 1415, 1417, 1419, 1421, 1423, 1425, 1427, 1429, 1431, 1433, 1435, 1437, 1439, 1441, 1443, 1445, 1447, 1449, 1451, 1453, 1455, 1457, 1459, 1461, 1463, 1465, 1467, 1469, 1471, 1473, 1475, 1477, 1479, 1481, 1483, 1485, 1487, 1489, 1491, 1493, 1495, 1497, 1499, 1501, 1503, 1505, 1507, 1509, 1511, 1513, 1515, 1517, 1519, 1521, 1523, 1525, 1527, 1529, 1531, 1533, 1535, 1537, 1539, 1541, 1543, 1545, 1547, 1549, 1551, 1553, 1555, 1557, 1559, 1561, 1563, 1565, 1567, 1569, 1571, 1573, 1575, 1577, 1579, 1581, 1583, 1585, 1587, 1589, 1591, 1593, 1595, 1597, 1599, 1601, 1603, 1605, 1607, 1609, 1611, 1613, 1615, 1617, 1619, 1621, 1623, 1625, 1627, 1629, 1631, 1633, 1635, 1637, 1639, 1641, 1643, 1645, 1647, 1649, 1651, 1653, 1655, 1657, 1659, 1661, 1663, 1665, 1667, 1669, 1671, 1673, 1675, 1677, 1679, 1681, 1683, 1685, 1687, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733 and 1735.

In another embodiment, $X_A$ is C and $X_B$ is K in these sequences from WO2012/004384, so the albumin binding polypeptide comprises an amino acid sequence selected from the group consisting of SEQ ID NO:1, 1005, 1009, 1013, 1017, 1021, 1025, 1029, 1033, 1037, 1041, 1045, 1049, 1053, 1057, 1061, 1065, 1069, 1073, 1077, 1081, 1085, 1089, 1093, 1097, 1101, 1105, 1109, 1113, 1117, 1121, 1125, 1129, 1133, 1137, 1141, 1145, 1149, 1153, 1157, 1161, 1165, 1169, 1173, 1177, 1181, 1185, 1189, 1193, 1197, 1201, 1205, 1209, 1213, 1217, 1221, 1225, 1229, 1233, 1237, 1241, 1245, 1249, 1253, 1257, 1261, 1265, 1269, 1273, 1277, 1281, 1285, 1289, 1293, 1297, 1301, 1305, 1309, 1313, 1317, 1321, 1325, 1329, 1333, 1337, 1341, 1345, 1349, 1353, 1357, 1361, 1365, 1369, 1373, 1377, 1381, 1385, 1389, 1393, 1397, 1401, 1405, 1409, 1413, 1417, 1421, 1425, 1429, 1433, 1437, 1441, 1445, 1449, 1453, 1457, 1461, 1465, 1469, 1473, 1477, 1481, 1485, 1489, 1493, 1497, 1501, 1505, 1509, 1513, 1517, 1521, 1525, 1529, 1533, 1537, 1541, 1545, 1549, 1553, 1557, 1561, 1565, 1569, 1573, 1577, 1581, 1585, 1589, 1593, 1597, 1601, 1605, 1609, 1613, 1617, 1621, 1625, 1629, 1633, 1637, 1641, 1645, 1649, 1653, 1657, 1661, 1665, 1669, 1673, 1677, 1681, 1685, 1689, 1693, 1697, 1701, 1705, 1709, 1713, 1717, 1721, 1725, 1729 and 1733.

In another embodiment, the albumin binding polypeptide comprises a mutated version of any one of the amino acid sequences specified in claim 23 of WO2012/004384. Thus, in this embodiment, the albumin binding polypeptide comprises an amino acid sequence selected from the group consisting of SEQ ID NO:1-4, 1017-1020, 1021-1024, 1029-1032, 1033-1036, 1041-1044, 1045-1048, 1053-1056, 1061-1064, 1065-1068, 1073-1076, 1077-1080, 1085-1088, 1089-1092, 1097-1100, 1101-1104, 1109-1112, 1113-1116, 1121-1124, 1125-1128, 1133-1136, 1137-1140, 1145-1148, 1149-1152, 1161-1164, 1165-1168, 1193-1196, 1197-1200, 1577-1580, 1581-1584, 1585-1588, 1589-1592, 1593-1596, 1597-1600, 1601-1604, 1689-1692, 1693-1696, 1697-1700, 1701-1704, 1705-1708, 1709-1712, 1713-1716, 1717-1720, 1721-1724, 1725-1728, 1729-1732 and 1733-1736.

In another embodiment, $X_A$ is C and $X_B$ is C or K in these sequences from claim 23 of WO2012/004384, so the albumin binding polypeptide comprises an amino acid sequence selected from the group consisting of SEQ ID NO:1, 3, 1017, 1019, 1021, 1023, 1029, 1031, 1033, 1035, 1041, 1043, 1045, 1047, 1053, 1055, 1061, 1063, 1065, 1067, 1073, 1075, 1077, 1079, 1085, 1087, 1089, 1091, 1097, 1099, 1101, 1103, 1109, 1111, 1113, 1115, 1121, 1123, 1125, 1127, 1133, 1135, 1137, 1139, 1145, 1147, 1149, 1151, 1161, 1163, 1165, 1167, 1193, 1195, 1197, 1199, 1577, 1579, 1581, 1583, 1585, 1587, 1589, 1591, 1593, 1595, 1597, 1599, 1601, 1603, 1689, 1691, 1693, 1695, 1697, 1699, 1701, 1703, 1705, 1707, 1709, 1711, 1713, 1715, 1717, 1719, 1721, 1723, 1725, 1727, 1729, 1731, 1733 and 1735.

In another embodiment, $X_A$ is C and $X_B$ is K in these sequences from claim 23 of WO2012/004384, so the albumin binding polypeptide comprises an amino acid sequence selected from the group consisting of SEQ ID NO:1, 1017, 1021, 1029, 1033, 1041, 1045, 1053, 1061, 1065, 1073, 1077, 1085, 1089, 1097, 1101, 1109, 1113, 1121, 1125, 1133, 1137, 1145, 1149, 1161, 1165, 1193, 1197, 1577, 1581, 1585, 1589, 1593, 1597, 1601, 1689, 1693, 1697, 1701, 1705, 1709, 1713, 1717, 1721, 1725, 1729 and 1733.

In another embodiment, the albumin binding polypeptide comprises an ABM sequence listed in PCT publication WO2014/048977, mutated as described herein through substitution in the $X_A$ and $X_B$ positions. Thus, in this embodiment, the albumin binding polypeptide comprises an amino acid sequence selected from the group consisting of SEQ ID NO:1737-1768.

In another embodiment, $X_A$ is C and $X_B$ is C or K in these sequences from PCT publication WO2014/048977, so the albumin binding polypeptide comprises an amino acid sequence selected from the group consisting of SEQ ID NO: 1737, 1739, 1741, 1743, 1745, 1747, 1749, 1751, 1753, 1755, 1757, 1759, 1761, 1763, 1765 and 1767.

In another embodiment, $X_A$ is C and $X_B$ is K in these sequences from PCT publication WO2014/048977, so the albumin binding polypeptide comprises an amino acid sequence selected from the group consisting of SEQ ID NO: 1737, 1741, 1745, 1749, 1753, 1757, 1761 and 1765.

In another embodiment, the albumin binding polypeptide comprises an ABM sequence which is a mutated version of the albumin binding motif sequence disclosed in claim 2 of PCT publication WO2014/048977. Thus, in this embodiment, the albumin binding polypeptide comprises an amino acid sequence selected from the group consisting of SEQ ID NO:1737-1740.

In another embodiment, $X_A$ is C and $X_B$ is C or K in this sequence from claim 2 of PCT publication WO2014/048977, so the albumin binding polypeptide comprises an amino acid sequence selected from the group consisting of SEQ ID NO: 1737 and 1739.

In another embodiment, $X_A$ is C and $X_B$ is K in this sequence from claim 2 of PCT publication WO2014/048977, so the albumin binding polypeptide comprises SEQ ID NO:1737.

In one embodiment, K, when present in position $X_A$ or $X_B$, is functionalized. Such functionalization may for example be by a method selected from haloacetylation, maleimide functionalization and pyridyldithiol functionalization. Thus, in one embodiment, K, when present in position $X_A$ or $X_B$, comprises a haloocetyl group, such as a flouroacetyl group, chloroacetyl group, bromoacetyl group or iodoacetyl group. In another embodiment, K, when present in position $X_A$ or $X_B$, comprises a chloroacetyl group.

In one embodiment of the first aspect of the present disclosure, there is provided an albumin binding polypeptide as defined herein, wherein the amino acid sequence of said albumin binding polypeptide is crosslinked. In one embodiment, said crosslink extends between the amino acid residue in position $X_A$ and the amino acid residue in position $X_B$ of the amino acid sequence.

Crosslinking is a method that can be used in order to stabilize proteins in a specific three dimensional conformation. As used herein, the term "crosslinking" involves covalently attaching a protein to another macromolecule, such as another protein, or to the same macromolecule, such as the same protein, or to something else, such as a solid support. Hence, crosslinking may be intra-molecular and inter-molecular, such as intra-molecular crosslinking within an albumin binding polypeptide as defined herein.

Herein, the terms "crosslinker" and "crosslinking agent" refer to a molecule with at least two reactive ends, which may be used to connect polymer chains, such as amino acid chains. Crosslinkers are usually reactive toward functional groups common on amino acids, such as carboxyl groups, amine groups and sulfhydryl groups.

Known in the art are homobifunctional crosslinkers, which have the same reactive groups on each end of the crosslinker. Non-limiting examples of homobifunctional crosslinkers are dihalogenated crosslinkers, dimaleimide crosslinkers, dipyridyldithiol crosslinkers and perfluoroaromatic crosslinkers.

Also known are heterobifunctional crosslinkers, which have different reactive groups on each end of the crosslinker. Reactive groups of heterobifunctional crosslinkers may be chosen such that a specific crosslinking target (for example a protein or an amino acid residue) will bind to one end and another specific crosslinking target will bind to the other end of said crosslinker.

Thus, the skilled person is aware of many types of crosslinkers. Known in the art are for example haloacetyl and maleimide crosslinkers, which react with sulfhydryl groups at physiological pH to form thioether linkages. Also known are pyridyl disulfide crosslinkers, which react with sulfhydryl groups to form disulfide bonds. Other types of crosslinkers include N-hydroxysuccinimide esters, imido esters, carbodiimides and diazirines. Examples of some common crosslinkers are the imido ester crosslinker dimethyl suberimidate and the N-hydroxysuccinimide ester crosslinker BS3. These crosslinkers induce a nucleophilic attack of the amino group of the lysine side chain, resulting in covalent bond formation via the crosslinker.

Crosslinking may involve chemoselective crosslinking chemistries, such as thioether bond formation between a haloacetylated, maleimide-functionalized or pyridyldithiol-functionalized lysine residue and the thiol group of a cysteine residue. Another example is thioether bond formation between a haloacetylated, maleimide-functionalized or pyridyldithiol-functionalized lysine residue and a lysine residue modified by coupling of a thiol-containing reagent, such as mercaptoacetic acid or mercaptopropionic acid to the lysine amino group. Chemoselective crosslinking chemistries may also involve thioether bond formation between the thiol groups of two cysteine residues and a bifunctional dihalogenated linker, dimaleimide linker, dipyridyldithiol linker or perfluoroaromatic linker. Also, chemoselective crosslinking chemistries may involve disulfide bond formation between thiol groups of cysteine residues and/or thiol groups of lysine residues modified by coupling of thiol-containing reagents thereto as described above; oxime bond formation between an aminooxy-modified amino acid residue and an aldehyde-modified or ketone-modified amino acid residue, bond formation via Staudinger reaction between an azido-modified amino acid residue and a triarylphosphine-modified amino acid residue as well as bond formation via native chemical ligation reaction between a thioester-modified amino acid residue and a cysteine-modified amino acid residue. The skilled person will appreciate that said crosslink can be obtained by any chemoselective crosslinking chemistry mentioned above or any other suitable chemistry or method.

Thus, in one embodiment, there is provided a crosslinked albumin binding polypeptide, wherein said crosslink is selected from the group comprising thioether bond between a haloacetylated lysine residue and a thiol group of a cysteine residue or thiol-modified lysine residue, thioether bond between a maleimide-functionalized lysine residue and a thiol group of a cysteine residue or thiol-modified lysine residue, thioether bond between a pyridyldithiol-functionalized lysine residue and a thiol group of a cysteine residue or thiol-modified lysine residue, thioether bond between the thiol groups of cysteine residues or thiol-modified lysine residues and a bifunctional dihalogenated linker, thioether bond between the thiol groups of cysteine residues or thiol-modified lysine residues and a bifunctional dimaleimide linker, thioether bond between the thiol groups of cysteine residues or thiol-modified lysine residues and a bifunctional dipyridyldithiol linker, thioether bond between the thiol groups of cysteine residues or thiol-modified lysine residues and a bifunctional perfluoroaromatic linker, disulfide bond between the thiol groups of cysteine residues or thiol-modified lysine residues, oxime bond between an aminooxy-modified amino acid residue and an aldehyde-modified amino acid residue, oxime bond between an aminooxy-modified amino acid residue and a ketone-modified amino acid residue, bond formed by Cu-catalyzed cycloaddition between an azido-modified amino acid residue and an alkyne-modified amino acid residue, bond formed by Staudinger reaction between an azido-modified amino acid residue and a triarylphosphine-modified amino acid residue, and bond formed by native chemical ligation reaction between a thioester-modified amino acid residue and a cysteine-modified amino acid residue.

In one embodiment, said crosslink is a thioether bond, such as a thioether bond between a haloacetylated lysine residue and the thiol group of a cysteine residue. For example, such a thioether bond may be between a chloroacetylated lysine residue and the thiol group of a cysteine residue. In another embodiment, said thioether bond is between a chloroacetylated lysine residue and the thiol group of a mercaptoacetylated lysine residue.

In another embodiment, said crosslink is a disulfide bond between the thiol groups of two cysteine residues, such as a disulfide bond obtained by using a dihalide crosslinker. In one embodiment, said crosslinker is selected from the group consisting of o-xylylene dibromide, m-xylylene dibromide, p-xylylene dibromide, 2,3-bis(bromomethyl)quinoxaline and 2,6-bis(bromomethyl)pyridine, such as from the group consisting of o-xylylene dibromide, m-xylylene dibromide and 2,6-bis(bromomethyl)pyridine.

As stated above, the skilled person is aware that the function of any polypeptide, such as the albumin binding capacity of the polypeptides according to the present disclosure, is dependent on the tertiary structure of said polypeptide. The skilled person is also aware of the three-helix bundle domain structure of G148-GA3 and its various known derivatives, and thus appreciates that the albumin binding polypeptides described herein need to retain essentially the same tertiary structure when crosslinked as their non-crosslinked counterpart or counterparts in order to retain essentially the same albumin binding properties. In one embodiment, there is provided a crosslinked albumin binding polypeptide, in which said albumin binding motif retains a two alpha helix conformation. In another embodiment, there is provided a crosslinked albumin binding polypeptide, wherein said albumin binding motif forms part of a polypeptide which retains a three-helix bundle conformation.

The present disclosure contemplates albumin binding polypeptides with a high level of resistance to proteolytic cleavage, such as proteolytic cleavage within the gastrointestinal tract. Without wishing to be bound by theory, in embodiments in which the albumin binding polypeptide is crosslinked, it is thought that it is the crosslink that provides such resistance. Albumin binding polypeptides which exhibit such increased resistance to proteolytic cleavage may more suitable for oral delivery.

Examples of proteolytic enzymes present in the gastrointestinal tract are pepsin, found in the stomach, trypsin and chymotrypsin, both found in the duodenum.

Thus, in one embodiment there is provided an albumin binding polypeptide that is resistant to proteolytic cleavage, such as proteolytic cleavage by at least one protease of the gastrointestinal tract. In one embodiment, said at least one protease is selected from the group consisting of pepsin, trypsin and chymotrypsin, and all possible combinations thereof. In another embodiment, said at least one protease is pepsin. In another embodiment, said at least one protease is trypsin. In another embodiment, said at least one protease is chymotrypsin.

In one embodiment of the present aspect of the disclosure, there is provided an albumin binding polypeptide, which exhibits a melting temperature (Tm) of at least 37° C., for example at least 39° C., for example at least 41° C., for example at least 43° C., for example at least 45° C., for example at least 47° C., for example at least 49° C., for example at least 51° C., for example at least 53° C., for example at least 55° C., for example at least 57° C., for example at least 59° C., for example at least 61° C., for example at least 63° C., for example at least 65° C., for example at least 67° C., for example at least 69° C., for example at least 71° C., for example at least 73° C., for example at least 75° C.

The terms "albumin binding" and "binding affinity for albumin" as used in this specification refer to a property of a polypeptide which may be tested for example by the use of surface plasmon resonance technology, such as in Biacore (GE Healthcare) or ProteOn XPR 36 (Bio-Rad) instrument. For example as described in the examples below, albumin binding affinity may be tested in an experiment in which albumin, or a fragment thereof, is immobilized on a sensor chip of the instrument, and the sample containing the polypeptide to be tested is passed over the chip. Alternatively, the polypeptide to be tested is immobilized on a sensor chip of the instrument, and a sample containing albumin, or a fragment thereof, is passed over the chip. Albumin may, in this regard, be serum albumin from a mammal, such as human serum albumin. The skilled person may then interpret the results obtained by such experiments to establish at least a qualitative measure of the binding affinity of the polypeptide for albumin. If a quantitative measure is desired, for example to determine a $K_D$ value for the interaction, surface plasmon resonance methods may also be used. Binding values may for example be defined in a Biacore2000 instrument (GE Healthcare). Albumin is suitably immobilized on a sensor chip of the measurement, and samples of the polypeptide whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

In embodiments of this aspect of the disclosure, there is provided an albumin binding polypeptide which binds to albumin such that the $K_D$ value of the interaction is at most $1 \times 10^{-8}$ M, such as at most $1 \times 10^{-9}$ M, such as at most 1×10$^{-10}$ M, such as at most 1×10$^{-11}$ M, such as at most 1×10$^{-12}$ M. In one embodiment, said albumin is human serum albumin.

In a second aspect of the present disclosure, there is provided a compound comprising at least one moiety (I) which is an albumin binding polypeptide as described in the first aspect;

one moiety (II) which confers a desired therapeutic activity; and optionally, at least one further moiety (III) which confers a desired therapeutic activity, which activity may be the same or different from said activity of moiety (II).

Thus, the second aspect of the present disclosure provides a compound which comprises as moiety (I) an albumin binding polypeptide as defined in connection with the first aspect. When present as moiety (I) in such a compound, this albumin binding may, in any combination, exhibit any one or more of the properties, features, characteristics and/or embodiments described above in connection with the first aspect of the disclosure. For the sake of brevity, this information will not be repeated in connection with this second aspect, but is incorporated by reference to the above disclosure.

The compound as defined above comprises at least moieties (I) and (II) and optionally moiety (III). The moieties may for example be connected by covalent coupling using known organic chemistry methods, or, if one or both moieties are polypeptides, be expressed as one or more fusion polypeptides in a system for recombinant expression of polypeptides, or joined in any other fashion, directly or via a linker, for example a linker comprising a number of amino acid residues. For discussions concerning the coupling of albumin binding moieties to other moieties, for example in order to provide a compound as defined above, see for example PCT publications WO2009/016043, WO2012/004384 and WO2014/048977, from which the relevant sections are incorporated herein by reference.

As defined herein, said compound comprises at least one moiety (I), such as two, three, four or more moieties (I). Similarly to the above, moieties (I) may be coupled to each other by means of chemical conjugation (using known organic chemistry methods) or by any other means, such as expression of said moieties as a fusion protein or joined in any other fashion, either directly or via a linker, for example an amino acid linker. Said moieties (I) may be the same or different.

The designations moiety (I), moiety (II) and moiety (III) are made for clarity reasons to distinguish between the herein disclosed albumin binding polypeptide (moiety (I)) and moieties exhibiting other functions. These designations are not intended to refer to the actual order of the different domains in the polypeptide chain of the fusion protein or conjugate. Thus, for example, said first moiety may without restriction appear at the N-terminal end, in the middle, or at the C-terminal end of the fusion protein or conjugate. As a non-limiting illustration, moieties (I), (II) and (III) may for example be arranged as (I)-(II)-(I)-(III), (I)-(II)-(I), (I)-(I)-(II), (II)-(III)-(I)-(III), or in any other suitable manner. Thus, said compound may comprise any combination of moieties (I), (II) and optionally (III).

In one embodiment of this aspect, the part of the compound designated moiety (II) and/or (III) comprises a component selected from the group consisting of human endogenous enzymes, growth factors, chemokines, cytokines, blood clotting and complement factors, innate immune defense and regulatory peptides, for example selected from the group consisting of insulin, insulin analogs, IL-2, IL-5, GLP-1, BNP, IL 1-RA, KGF, Stemgen®, GH, G-CSF, CTLA-4, myostatin, Factor VII, Factor VIII and Factor IX, and derivatives of anyone thereof.

In another embodiment, moiety (II) and/or (III) comprises a non-human biologically active protein, selected from the group consisting of modulins, bacterial toxins, hormones, innate immune defense peptides, regulatory peptides, enzymes and activating proteins.

In yet another embodiment, moiety (II) and/or (III) comprises a binding polypeptide capable of selective interaction with a target molecule. Such a binding polypeptide may for example be selected from the group consisting of antibodies and fragments and domains thereof substantially retaining antibody binding activity; microbodies, maxybodies, avimers and other small disulfide-bonded proteins; and binding proteins derived from a scaffold selected from the group consisting of staphylococcal protein A and domains thereof, other three helix domains, lipocalins, ankyrin repeat domains, cellulose binding domains, γ crystallines, green fluorescent protein, human cytotoxic T lymphocyte-associated antigen 4, protease inhibitors such as Kunitz domains, PDZ domains, SH3 domains, peptide aptamers, staphylococcal nuclease, tendamistats, fibronectin type III domain, transferrin, zinc fingers and conotoxins.

In some examples of such an embodiment, the binding polypeptide comprises a variant of protein Z, in turn derived from domain B of staphylococcal protein A and described in Nilsson B et al, Protein Engineering 1:107-133, 1987. Such variants, having affinity for a number of different targets, have been selected from libraries and engineered further as described in numerous prior publications, starting with WO95/19374 and the article by Nord et al in Nat Biotech (1997) 15:772-777. In this embodiment of a compound for use according to the present disclosure, the variant of protein Z which corresponds to moiety (II) and/or (III) comprises a scaffold amino acid sequence selected from SEQ ID NO:1775-1781 (see Table 1), wherein X denotes any amino acid residue. As described in the references above, the amino acid positions denoted X are all involved in the binding function of the protein Z variant, and will vary depending on what target the Z variant is designed to bind. Preferably, in these embodiments, the scaffold amino acid sequence of moiety (II) or (III) comprises SEQ ID NO:1775.

TABLE 1

Scaffold amino acid sequences of protein Z variants

| SEQ ID NO | Amino acid sequence |
|---|---|
| 1775 | EXXXAXXEIX XLPNLTXXQX XAFIXKLXDD PSQSSELLSE AKKLNDSQ |
| 1776 | VDNKFNKEXX XAXXEIXXLP NLNXXQXXAF IXSLXDDPSQ SANLLAEAKK LNDAQAPK |
| 1777 | EXXXAXXEIX XLPNLTXXQX XAFIXKLXDD PSQSSELLSE AKKLSESQ |
| 1778 | EXXXAXXEIX XLPNLTXXQX XAFIXKLXDD PSQSSELLSE AKKLESSQ |
| 1779 | EXXXAXXEIX XLPNLTXXQX XAFIXKLXRQ PEQSSELLSE AKKLNDSQ |
| 1780 | EXXXAXXEIX XLPNLTXXQX XAFIXKLXRQ PEQSSELLSE AKKLSESQ |
| 1781 | EXXXAXXEIX XLPNLTXXQX XAFIXKLXRQ PEQSSELLSE AKKLESSQ |

In embodiments of this aspect, wherein moiety (II) and/or (III) comprises a binding polypeptide capable of selective interaction with a target molecule, said target molecule may be selected from the group consisting of tumor-related or other cell surface related antigens, such as CD14, CD19, CD20, CD22, CD30, CD33, CD37, CD40, CD52, CD56, CD70, CD138, cMet, HER1, HER2, HER3, HER4, CAIX, CEA, IL-2 receptor, IGF1R, VEGFR2, EGFR, FcRn, MUC1, PDGFR-beta, PSMA, TAG-72, FOLR1, mesothelin, CA6, GPNMB, integrins and ephA2; cytokines such as TNF-α, IL-1α, IL-1β, IL-1Ra, IL-5, IL-6, IL-13, IL-17A, IL-18, IL-23, IL-36, G-CSF, GM-CSF, and their receptors; chemokines such as IL-8, CCL-2 and CCL11, and their receptors; complement factors such as C3, C5 and factor D; growth factors such as HGF and myostatin; hormones such as GH, insulin and somatostatin; peptides such as Aβ peptide of Alzheimer's disease; other disease-associated amyloid peptides; hypersensitivity mediators such as histamine and IgE, immunoglobulins such as IgG; blood clotting factors, such as von Willebrand factor; and toxins, such as bacterial toxins and snake venoms.

In an alternative embodiment, moiety (II) and/or (III) comprises a non-proteinaceous component having a therapeutic activity. Examples of particular interest are cytotoxic agents and anti-inflammatory agents, since albumin has been shown to accumulate in tumor tissues and at sites of inflammation (Kratz and Beyer, Drug Delivery 5: 281-99, 1998; Wunder et al, J. Immunol. 170: 4793-801, 2003). This, in turn, provides a rationale for oral delivery of such compounds together with the albumin binding moiety for targeting and accumulation at relevant tumor tissues or inflammation sites. Non-limiting examples of cytotoxic agents are calicheamycin, auristatin, doxorubicin, maytansinoid, taxane, ecteinascidin, geldanamycin, methotrexate, camptothecin, cyclophosphamide, cyclosporine and their derivatives, and combinations thereof. Non-limiting examples of anti-inflammatory agents are non-steroidal anti-inflammatory drugs (NSAIDs), cytokine suppressive anti-inflammatory drugs (CSAIDs), corticosteroids, methotrexate, prednisone, cyclosporine, morroniside cinnamic acid, leflunomide and their derivatives, and combinations thereof.

In such embodiments, the non-proteinaceous moiety (II) and/or (III) and albumin binding moiety (I) may be non-covalently associated or covalently coupled together. Conjugation of a non-proteinaceous moiety (II) or (III) to an albumin binding moiety (I) may increase the solubility, and thereby the bioavailability, of poorly soluble compounds otherwise not suitable for oral administration.

In a third aspect of the present disclosure, there is provided a pharmaceutical composition comprising the compound as described herein and at least one pharmaceutically acceptable excipient.

Thus, the third aspect of the present disclosure provides a pharmaceutical composition which comprises as one component a compound as defined in connection with the second aspect. When present in a pharmaceutical composition, this compound may, in any combination, exhibit any one or more of the properties, features, characteristics and/or embodiments described above in connection with the second aspect of the disclosure. For the sake of brevity, this information will not be repeated in connection with this third aspect, but is incorporated by reference to the above disclosure.

The pharmaceutical composition also comprises at least one pharmaceutically acceptable excipient. "Excipients" are inert substances used as diluents or vehicles in a drug formulation. An excipient is mixed with the therapeutically active compound or compounds to facilitate administration or manufacture, improve product delivery, promote the consistent release and bioavailability of the drug, enhance stability, assist in product identification, or enhance other product characteristics. Excipients may be classified into binders, diluents/fillers, lubricants, glidants, disintegrants, polishing agents, colorings, suspending agents, film formers and coatings, plasticizers, dispersing agents, preservatives, flavorings, sweeteners etc.

In some embodiments of the inventive pharmaceutical composition, it further comprises at least one component for increasing oral bioavailability of the compound which confers a desired therapeutic activity. In those embodiments, the component in question may be selected from the group consisting of protease inhibitors, absorbance enhancers, mucoadhesive polymers, formulation vehicles and any combination thereof. Uses of such components and the scientific rationale behind them are described in the following sections, concerning general strategies to improve the oral bioavailability of therapeutics.

The resistance of the pharmaceutical composition to the acid and enzymatic environment of the gastrointestinal tract may be (further) increased by adding one or more inhibitors (cocktails or individually targeting) of the relevant peptide- and protein-targeting enzymes active in the stomach (e.g. pepsin) and the intestine (e.g. trypsin, chymotrypsin and carboxypeptidase). Such inhibitors may be selected from trypsin and α-chymotrypsin inhibitors such as pancreatin inhibitor, soybean trypsin inhibitor, FK-448, camostat mesylate, aprotinin, chicken and duck ovomucoids, carboxymethylcellulose and Bowman-Birk inhibitor; or mucoadhesive polymer protease-inhibitor conjugates (Park et al, Reactive and Functional Polymers, 71:280-287, 2011).

To increase the absorption of polypeptides though the intestinal wall and hence improve the therapeutic efficacy, absorbance enhancers rendering the epithelial barrier more permeable may be included in the pharmaceutical composition. The absorbance enhancers may for instance disrupt the lipid bilayer of the cell membrane improving the transcellular transport, or act as chelating agents rupturing tight junctions facilitating paracellular transport. Non-limiting examples of absorbance enhancers for use in this aspect of the disclosure are detergents, surfactants, bile salts, calcium chelating agents, fatty acids, medium chain glycerides, salicylates, alkanoyl cholines, N-acetylated α-amino acids, N-acetylated non-α-amino acids, chitosans, phospholipids, sodium caprate, acyl carnitine and Zonula Occludens toxin (Park et al, 2011, supra; Salama et al, Adv Drug Deliv Rev. 58:15-28, 2006).

As an additional or alternative component in the pharmaceutical composition, mucoadhesive polymers have the potential to protect from proteolytic degradation, but are primarily applied to provide site-specific delivery to the mucus membrane, extend the residence time at the site of drug absorption and to improve membrane permeation, all promoting increased absorbance through the intestinal wall. Non-limiting examples for use in the inventive pharmaceutical composition are poly(methacrylic acid-g-ethylene glycol)[P(MAA-g-EG)] hydrogel microparticles, lecithin conjugated alginate microparticles, thiolated polymers (thiomers), gastrointestinal mucoadhesive patch systems (GI-MAPS) and mucoadhesive polymer protease-inhibitor conjugates (Park et al, 2011, supra).

Formulation vehicles, such as emulsions, liposomes, microspheres, nanospheres, nanocapsules or complete encapsulation, may contribute to the protection from proteolytic degradation and provide a controlled release rate, as well as promoting enhanced delivery across the intestinal wall. Such formulation vehicles constitute yet an alternative or complementary component for use in the inventive pharmaceutical composition. In particular, nanoparticles having modified surface properties or being coupled to a targeting molecule may be used. Surface modification of nanoparticles can for example be achieved either by coating with hydrophilic stabilizing, bioadhesive polymers or surfactants, or by incorporating hydrophilic copolymers in the nanoparticle formulation. Examples of such hydrophilic polymers include PEG and chitosan (des Rieux et al, J Control Release. 116:1-27, 2006). Targeting nanoparticles are designed to specifically adhere to receptors expressed on enterocytes or M-cells of the epithelial layer of the intestinal wall by for instance coupling ligands such as lectins or RGD (arginine-glycine-aspartate) derivatives to the nanoparticle (des Rieux et al, 2006, supra). M-cells also provide a route for delivery into the lymphatic system (Rubas and Grass, Advanced Drug Delivery Reviews, 7:15-69, 1991).

The pharmaceutical composition defined herein may for example be orally administered in solid form, such as in pills, tablets, capsules, powders or granules; in semi-solid form, such as in pastes; or in liquid form, such as in elixirs, solutions or suspensions. Solid forms may contain excipients such as chitosan, alginates, microcrystalline cellulose, lactose, saccharose, starch, gelatin, milk sugar, polyethylene glycols, polyvinylpyrrolidone (PVP), magnesium stearate, calcium stearate and sodium starch glycolate. Preparations in liquid forms may contain excipients such as sweetening or flavoring agents, emulsifying or suspending agents or diluents such as water, ethanol, propylene glycol and glycerin.

The formulation may be intended for immediate-, delayed- or controlled-release applications. Tablets or capsules intended for immediate release should rapidly disintegrate and release the entire active substance in the upper part of the GI tract, i.e. the stomach. On the contrary, tablets or capsules intended for delayed or controlled release can be designed for time-dependent release (depot) or site-specific release (e.g. intestine). Time-dependent release may for instance be based on dissolution or diffusion controlled release dependent on the matrix or membrane composition. Site-specific release may for instance be based on pH- or enzyme sensitivity. Particularly preferred for formulation of the pharmaceutical composition according to the third aspect are enteric-coated capsules, intended for release in the small intestine or colon. Such enteric-coated capsules should be stable at the highly acidic pH of the stomach, but be rapidly dissolved at the less acidic pH of the intestinal tract. Examples of pH sensitive enteric film forming agents include cellulose polymers such as hydroxypropyl methyl cellulosephthalate (HPMCP), cellulose acetate phthalate (CAP), cellulose acetate trimellitate (CAT), hydroxypropyl methyl acetatesuccinate (HPMCAS), polyvinyl acetate phthalate (PVAP), and other polymers such as EUDRAGIT derivatives, shellac (SH), chitosan and chitin.

In a fourth aspect of the disclosure, there is provided an albumin binding polypeptide, a compound or a pharmaceutical composition as defined in the first, second and third aspects respectively, for use in treatment, for example by oral administration.

In a related fifth aspect, there is provided a method of treatment of a mammalian subject in need of such treatment, comprising administration, for example oral administration, of a therapeutically effective amount of an albumin binding polypeptide, a compound or a pharmaceutical composition as defined in the first, second and third aspects respectively.

In a related sixth aspect, there is provided use of an albumin binding polypeptide, a compound or a pharmaceutical composition as defined in the first, second and third aspects respectively, for the preparation of a medicament for treatment, for example for treatment by oral administration.

In the fourth, fifth and sixth aspects, it will be understood that the albumin binding polypeptide, compound and pharmaceutical composition, respectively, may each individually exhibit any one or more of the properties, features, characteristics and/or embodiments described above in connection with the first, second and third aspects of the present disclosure, in any combination. For the sake of brevity, this information will not be repeated here, but is incorporated by reference to the above disclosure.

In one embodiment, said use or method of treatment is carried out according to a specified dosage regime. The optimal dosage regime will depend on the potency of the moiety conferring the therapeutic effect, on the bioavailability of the compound as defined herein and on the nature of the disease to be treated. However, the compound as defined herein, which comprises an albumin binding moiety that is thought to extend the half-life of the compound, is contemplated to not require a single high dose to reach the level of a therapeutic effect, but, due to the sustained residence time in the circulation, allows for administration of lower repeated doses leading to a build-up of the concentration of the compound, eventually reaching a sustainable desired therapeutic effect. In other words, following oral administration, a lower bioavailability than for a short-lived therapeutic would be acceptable. Such repeated dosing may be given at least twice monthly, once weekly, twice weekly, three times weekly, once daily, twice daily, such as at least three times daily.

For certain diseases it may be desirable to administer a bolus dose, followed by repeated lower doses. The bolus dose may be taken as multiples of an orally formulated drug, at least once daily, twice daily, three times daily, four times daily or at least five times daily. Alternatively, the high bolus dose may be administered via another route, such as by an intravenous or subcutaneous injection. Subsequent dosing, serving the purpose of providing a sustained therapeutic effect, may be given at least twice monthly, once weekly, twice weekly, three times weekly, once daily, twice daily, three times daily, such as at least four times daily.

While the present disclosure has been illustrated with reference to various exemplary aspects and embodiments, it will be understood by those skilled in the art that various changes may be made and equivalents may be substituted for elements thereof without departing from the scope of the disclosure. In addition, many modifications may be made to adapt a particular situation or molecule to the teachings of the present disclosure without departing from the essential scope thereof. Therefore, it is intended that the disclosure not be limited to any particular embodiment contemplated, but include all embodiments falling within the scope of the appended claims.

The present disclosure will now be further illustrated by the following non-limiting Examples.

BRIEF DESCRIPTION OF THE FIGURES

FIG. 1A-QQQ is a listing of the amino acid sequences of examples of albumin binding polypeptides of the present disclosure (SEQ ID NO:1-1768 and 1773), control polypeptides (SEQ ID NO:1769-1772 and 1774) and scaffold variants of target binding polypeptides based on protein Z (SEQ ID NO:1775-1781). In the albumin binding polypeptides of the present disclosure, the deduced albumin binding motifs, extending from position 16 to position 45 in each sequence, are enclosed by hyphens. For the avoidance of any doubt, these hyphens do not indicate the presence of deletion mutations.

EXAMPLE 1

Production of Polypeptides

Figure 2:
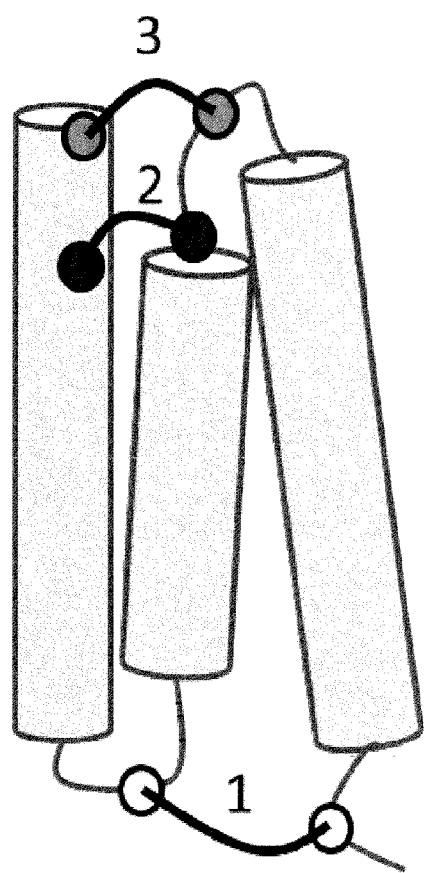
FIG. 2 shows a schematic structural model and positions used for intramolecular crosslinking: 1) $C_{17}$—$K_{45}$, 2) $K_5$—$C_{28}$ and 3) $C_1$—$K_{29}$.
Figure 3A:
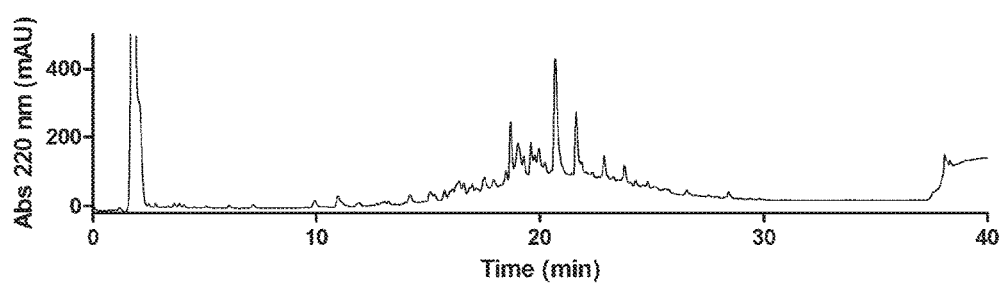
FIG. 3A-B is a diagram showing the result of RP-HPLC analysis of the crude synthetic polypeptide PEP18049. The chromatograms show the absorbance at 220 nm for the linear chloroacetylated PEP18049 before crosslinking (FIG. 3A), and the product after 3 h incubation, where the major peak, indicated by an arrow, contains the intramolecular crosslinked PEP18049_CL (FIG. 3B).
Figure 3B:
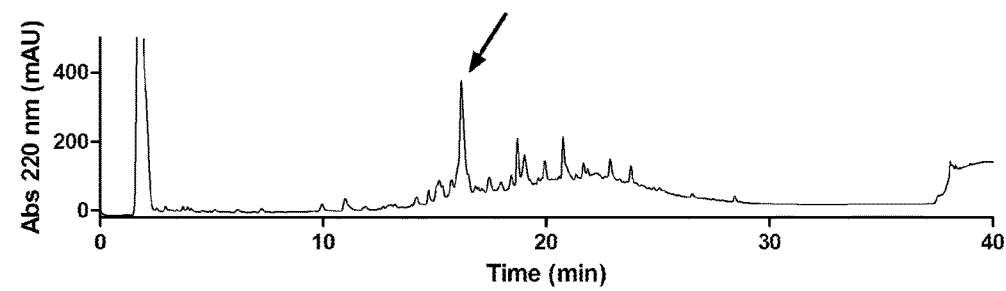

Seven polypeptides were produced by solid phase peptide synthesis (SPPS): PEP18049 (SEQ ID NO:1), PEP18050 (SEQ ID NO:1769), PEP18051 (SEQ ID NO:1770), PEP18052 (SEQ ID NO:1771), PEP18053 (SEQ ID NO:1772), PEP14788 (SEQ ID NO:3) and PEP07830 (SEQ ID NO:1774). The first five were designed to allow for intermolecular crosslinking between a functionalized lysine residue and a partner cysteine as further described in Example 2. PEP14788 was designed as a variant of PEP18049, but with two cysteines for crosslinking with a dihalide and to investigate the possibility to produce the tethered polypeptide using recombinant expression. Hence, this polypeptide, but with an N-terminal GSS, was also produced recombinantly and is here designated PEP14789 (SEQ ID NO:1773). PEP07830 was produced to be used as a linear (non-crosslinked) control in subsequent characterization analyses.

Materials and Methods

Production by Chemical Synthesis:

The polypeptides were synthesized on a 0.1 mmol scale using microwave-assisted SPPS on an automated peptide synthesizer with an integrated microwave oven (Liberty™, CEM Corporation, USA) using an amide resin as solid support (Rink Amide MBHA LL resin (Rink, Tetrahedron Lett 28:3787-3790, 1987), 100-200 mesh (Novabiochem), loading 0.36 mmol$^{-1}$). N-Methylpyrrolidone (NMP, Carlo Erba Reagent) was used for washing and as main solvent during the synthesis. Acylation reactions were performed using a five-fold excess of the amino acid activated with 2-(1H-benzotriazole-1-yl)-1,1,3,3-tetramethyluronium-hexafluorophosphate (HBTU, Iris Biotech), hydroxybenzotriazole (HOBt, Iris Biotech) and diisopropylethylamine (DIEA, Applied Biosystems), and added to the resin at a molar ratio of 1:1:1:2 (amino acid:HBTU:HOBt:DIEA). All Asn, Arg, Cys, Tyr and Lys (Mtt; 4-methyltrityl) were double coupled due to their bulky protective groups. Potentially unreacted amino groups were capped using acetic anhydride (0.5 M acetic anhydride (AlfaAesar), 0.125 M DIEA and 0.015 M HOBt) before the N-terminal Fmoc group was removed by piperazine treatment (5% piperazine (AlfaAesar) in NMP). All amino acids were introduced with standard side chain protection groups (tert-butyl (tBu) for Asp, Glu, Ser, Thr and Tyr, tert-butyloxycarbonyl (Boc) for Lys, 2,2,4,6,7-pentamethyldihydrobenzofuran-5-sulfonyl (Pbf) for Arg, and trityl (Trt) for Asn and Cys), except where indicated.

After completed synthesis, the N-terminal leucine of PEP18049 was capped with acetic anhydride (50 mM acetic anhydride (AlfaAesar), 150 mM DIEA and 1.5 mM HOBt). For the other synthetic variants (PEP18050, PEP18051, PEP18052, PEP18053 and PEP14788), the N-terminal leucine or cysteine was introduced as a Boc-protected amino acid, leaving the N-terminal protected until the peptide was cleaved from the resin. The Mtt group on Lys45 (in PEP18049, PEP18052 and PEP18053), Lys5 (in PEP18050 and PEP18052) and/or Lys29 (in PEP18051 and PEP18053) was removed by treatment with TFA/TIS/DCM (1:5:94) (TFA: trifluoroacetic acid (Merck), TIS: triisopropylsilane (Aldrich), DCM: dichloromethane (Applied Biosystems)) for 10×2 min. The free ε-amino group(s) was chloroacetylated by incubation for 1 h with chloroacetic acid (10 eq; Aldrich), preactivated with N,N'-dicyclohexylcarbodiimide (DCC, 5 eq) (Aldrich) and DIEA (10 eq) in DCM, and supplemented with 1 v/v DMF after activation. The chloroacetylation reaction was repeated two or three times.

Finally, the modified peptide was cleaved from the solid support and the side chains were deprotected by treatment with TFA/EDT/H$_2$O/TIS (94:2.5:2.5:1) (EDT: 1,2-ethanedithiol (Aldrich)), for 2 h at RT with occasional mixing. After TFA treatment, solid matter was removed by filtration and the peptides were precipitated using ice cold tert-butyl methyl ether (Merck). The precipitates were then centrifuged, the supernatant was removed, and fresh cold ether was added. This was repeated three times before the peptides were dissolved in 20% acetonitrile (Merck) in water with 0.1% TFA and lyophilized.

The crude peptides were either analyzed by RP-HPLC and LC-ESI-MS or used directly in crosslinking reactions. RP-HPLC was performed using a 4.6×150 mm Zorbax 300SB-C18 column connected to a 1200 series HPLC and LC-ESI-MS was performed on a 6520 Accurate Mass Q-TOF LC/MS (column and instruments from Agilent Technologies).

Production by Recombinant Expression:

PEP14789 was cloned and expressed in E. coli with an N-terminal MGSS-extension using standard methods essentially as described in Example 1 of WO2012/004384. Purification was performed by standard chromatography methods using affinity chromatography and reversed phase chromatography, also essentially as described in WO2012/004384.

Results

PEP18049, PEP18050, PEP18051, PEP18052, PEP18053, PEP14788 and PEP07830 were successfully produced by solid phase peptide synthesis and PEP14789 was produced by recombinant production. PEP18049, PEP18050, PEP18051, PEP18052 and PEP18053 were further functionalized with a chloroacetyl group at selected lysine residues (one or two at positions 5, 29 or 45). Mass spectrometry analysis confirmed the correct identity of all produced polypeptides.

EXAMPLE 2

Intramolecular Crosslinking of Albumin Binding Polypeptides

The polypeptides to be crosslinked were primarily designed so that a functionalized lysine residue has a partner cysteine that comes in close contact if the protein folds in a three-helical bundle, based on the three-dimensional structure solved for the G148-GA3 domain (PDB file: 1 GJS; Johansson et al, supra). A schematic structural model illustrating crosslinked positions investigated herein is shown in FIG. 2. A polypeptide variant crosslinked between two cysteine residues via a dihalide was also assessed. Amino acid residues used for crosslinking are specified in Table 2.

TABLE 2

Amino acid positions used for crosslinking

| SEQ ID NO (linear polypeptide) | Designation (crosslinked polypeptide) | Crosslinked positions |
|---|---|---|
| 1 | PEP18049_CL | Cys17-Lys45 |
| 1769 | PEP18050_CL | Lys5-Cys28 |
| 1770 | PEP18051_CL | Cys1-Lys29 |
| 1771 | PEP18052_CL | Lys5-Cys28 and Cys17-Lys45 |
| 1772 | PEP18053_CL | Cys1-Lys29 and Cys17-Lys45 |
| 3 | PEP14788_CL | Cys17-Cys45 |
| 1773 | PEP14789_CL | Cys17-Cys45 |

Materials and Methods

Crosslinking Via Lys-Cys:

For each variant, crude synthetic peptide was dissolved in phosphate-buffered saline (PBS; pH 7.4) supplemented with 10 mM ethylenediaminetetraacetic acid (EDTA; Merck) to a concentration of 2 mg ml$^{-1}$ and the reaction was allowed to proceed for 3 h or was left over night (approximately 18 h). For small-scale (~2 mg) cross-linking reactions, the reaction mixture was diluted 1:1 with 0.2% TFA/40% CH$_3$CN/60% H$_2$O, filtered and purified by RP-HPLC. For larger scale crosslinking reactions (10-20 mg), the buffer was changed to 25 mM ammonium acetate (Merck) pH 6 using PD-10 columns (GE Healthcare), and the product was lyophilized, dissolved in 0.1% TFA/20% CH$_3$CN/80% H$_2$O and purified using semi-preparative RP-HPLC (Zorbax 300SB-C18, 9.4× 250 mm, 5 μm particle size, Agilent Technologies) on a 1200 series instrument (Agilent Technologies) and analyzed by LC-ESI-MS.

Crosslinking Via Cys-Cys:

The crosslinking of PEP14788 and PEP14789 was performed by mixing the protein sample with a crosslinker pre-dissolved in dimethyl sulfoxide (DMSO, Sigma-Aldrich) in PBS (pH 7.4) supplemented with 10 mM EDTA to a concentration of 3 mg ml$^{-1}$. The following crosslinkers were used: A: o-xylylene dibromide (Alfa Aesar); B: m-xylylene dibromide (Merck); C: p-xylylene dibromide (Alfa Aesar); D: 2,3-bis(bromomethyl)-quinoxaline (Aldrich); and E: 2,6-bis(bromomethyl)pyridine (Aldrich). The pH was set to 8 by careful addition of 0.1 M NaOH. A 20-fold molar excess of the crosslinker was used to drive the reaction. The reaction was allowed to proceed for 2-3 h before the buffer was exchanged, and the protein lyophilized and purified as described above. After purification, the pure, crosslinked proteins were lyophilized.

Results

Crosslinking Via Lys-Cys:

The crosslinking reaction was performed by dissolving the protein in buffer under conditions where the protein is folded and the thiol group of the cysteine residue can form a nucleophilic attack on the α-carbon of the chloroacetyl group forming a thioether bond:

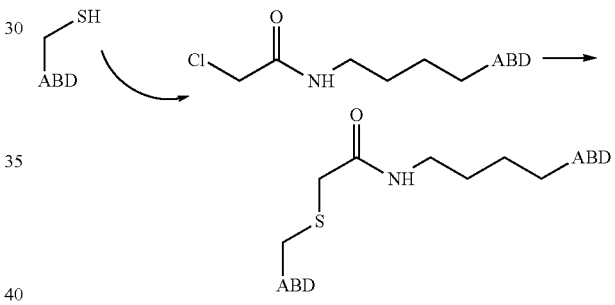

The crosslinking reaction was very efficient and clean for PEP18049, PEP18050 and PEP18051, which all contain one functionalized lysine. The clean reaction makes it possible to use crude and unpurified polypeptides in the reaction and obtain a pure crosslinked product in relatively high synthetic yield (such as a yield of 10-17% based on the HPLC elution profile at 220 nm). The crosslinking of PEP18052 and PEP18053, which both have two functionalized lysines, proved to be more complex. The expected MW of the double crosslinked protein was found in two separate peaks, which in later analysis showed the same behavior.

Crosslinking Via Cys-Cys:

The crosslinking of PEP14788 (which was produced chemically) and PEP14789 (which was produced recombinantly) was performed using a 20-fold excess of crosslinker to drive the reaction. Once one of the thiols has formed a covalent bond to the crosslinker, the second thiol should be in close contact as long as the polypeptide is correctly folded, and rapidly form the second covalent bond to the crosslinker. The reaction was very clean using the crosslinkers A (o-xylylene dibromide), B (m-xylylene dibromide) and E (2,6-bis(bromomethyl)pyridine), and no purification of the synthetic polypeptide was needed before crosslinking. The major by-product was the disulfide crosslinked protein, which could be completely removed by adding a reducing agent to the crosslinking buffer. Reactions using the crosslinkers C (p-xylylene dibromide) and D (2,3-bis(bromomethyl)-quinoxaline) were less efficient and polypeptides including these linkers were not analyzed further. The Cys-Cys crosslinked variants are herein referred to as PEP14788_CL_X and PEP14789_CL_X where X specifies linker A, B or E.

EXAMPLE 3

Circular Dicroism Spectroscopy Analysis

In this Example, circular dicroism (CD) spectroscopy was used to analyze the secondary structure of the chemically synthesized and crosslinked polypeptides produced as described in Example 1 and 2. Additionally, where it was possible, the melting temperatures (Tm) of said polypeptides were determined.

Materials and Methods

Polypeptides were dissolved in PBS (pH 7.4) to a concentration of 50 µM (approximately 0.25 mg ml$^{-1}$) and CD spectra and melting curves were collected on a Jasco J-810 spectropolarimeter (Jasco) using a cell with an optical path-length of 1 mm. Variable temperature measurements, VTM, were used to determine Tm. In these measurements, the absorbance was measured at 221 nm from 20° C. to 90° C., with a temperature slope of 5° C. min$^{-1}$. The secondary structure of each variant was analyzed by recording a spectrum ranging from 250 to 195 nm at 20° C., both before and after VTM.

Results

Figure 4A:
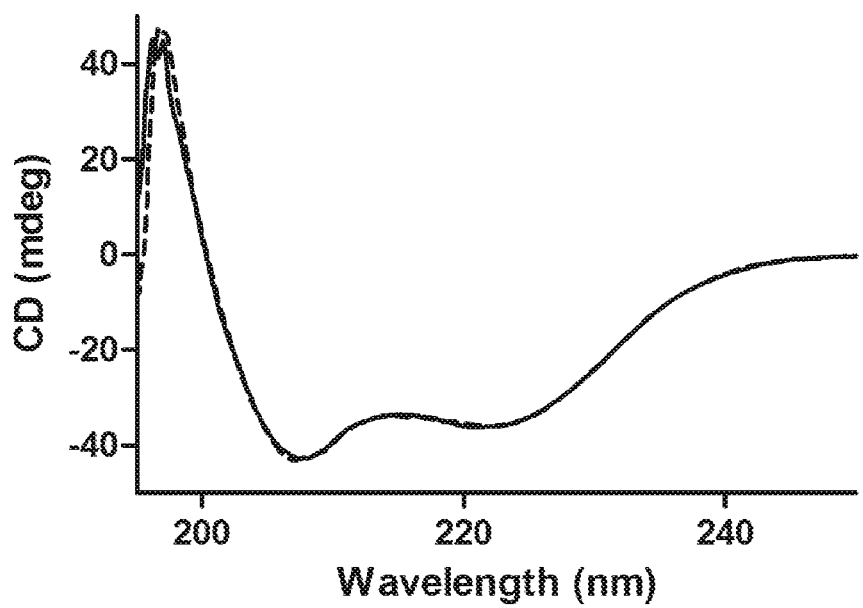
FIG. 4A-C shows overlays of the CD spectra of test and control polypeptides before (solid line) and after (broken line) heat treatment of A) crosslinked PEP18049_CL; and B) linear reference polypeptide PEP07830, and C) shows normalized variable temperature measurements, VTM, of PEP18049_CL (solid line) and PEP07830 (broken line).
Figure 4B:
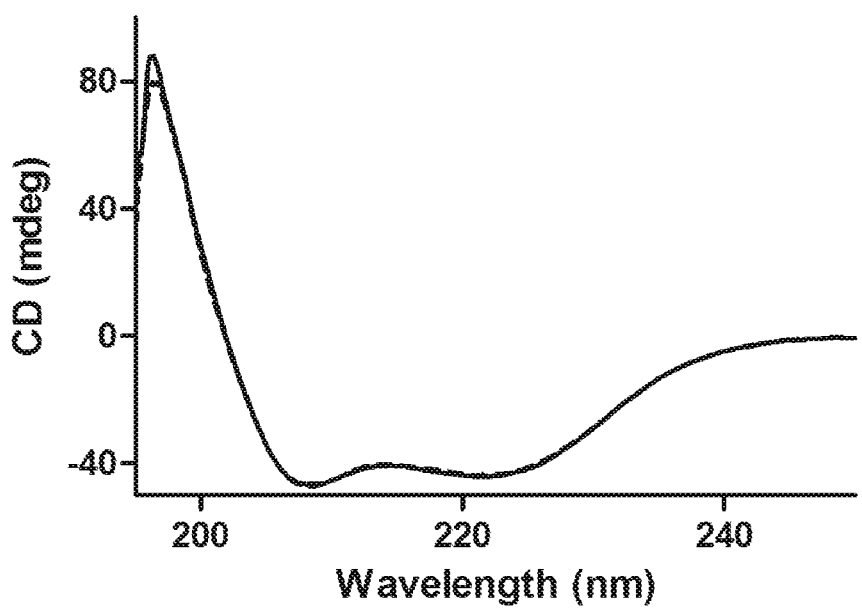

The CD spectra of PEP18049_CL and the reference protein PEP07830 have local minima at 208 nm and 221 nm, as is typical for alpha helical proteins (FIGS. 4A and 4B). PEP14788_CL_A, PEP14788_CL_B and PEP14788_CL_E also display these typical CD spectra. The four other crosslinked variants did not show these characteristic spectra, indicating that the α-helical secondary structure was partly or completely lost in these molecules.

Figure 4C:
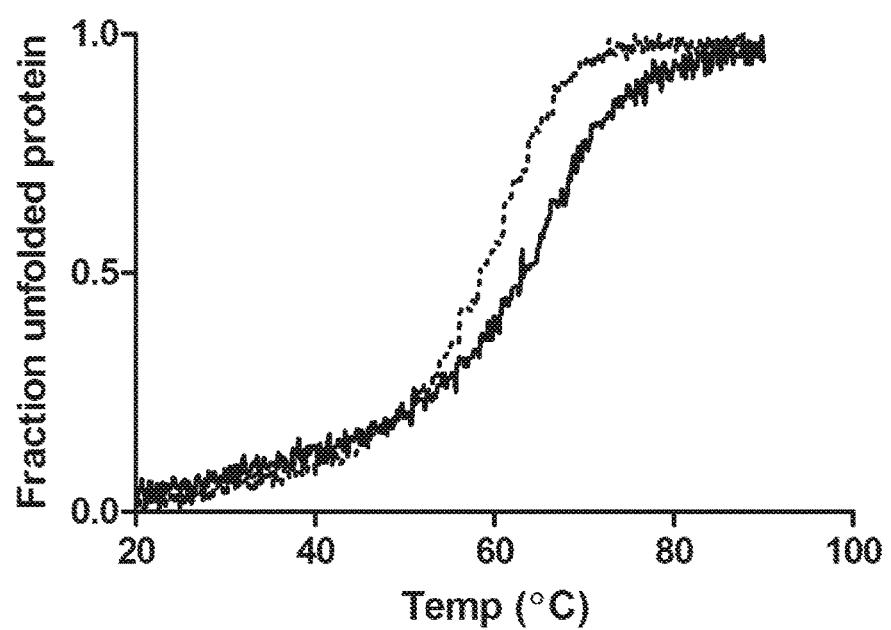

VTMs were collected for all polypeptide versions using the CD signal at 221 nm. The melting profiles of PEP18049_CL and the reference protein PEP07830 show a clear transition, indicating a cooperative unfolding of the protein characteristic of a well folded protein (FIG. 4C). The melting temperatures were calculated by determining the midpoint of the transition in the CD versus temperature plot. PEP18049_CL exhibited a Tm of 63° C., corresponding to an increase of approximately 5° C. compared to the Tm of PEP07830, and indicating a more stable protein. The melting profiles of PEP14788_CL_A, PEP14788_CL_B and PEP14788_CL_E showed a lower Tm compared to the reference protein PEP07830 (Table 3). The melting temperatures for the less structured crosslinked variants could not be determined.

TABLE 3

Melting temperatures of crosslinked and reference polypeptides.

| SEQ ID NO of linear polypeptide | Polypeptide variant | Tm (° C.) |
|---|---|---|
| 1774 | PEP07830 | 58 |
| 1 | PEP18049_CL | 63 |
| 3 | PEP14788_CL_A | ~55 |
| 3 | PEP14788_CL_B | ~51 |
| 3 | PEP14788_CL_E | ~45 |

EXAMPLE 4

Albumin Binding Analysis

This Example describes the analysis of the albumin binding ability of chemically synthesized, as well as recombinantly expressed, crosslinked polypeptides produced as described in Examples 1 and 2.

Materials and Methods

Biosensor binding analyses were performed on a ProteOn XPR36 instrument (Bio-Rad) at 25° C. using PBST (150 mM NaCl, 8 mM Na$_2$HPO$_4$, 2 mM NaH$_2$PO$_4$, 0.005% Tween20, pH 7.4) as running buffer at a flow rate of 50 µl min$^{-1}$. An injection of 30 µl of 20 mM HCl at a flow rate of 100 µl min$^{-1}$ was used for chip regeneration. In a screening experiment, the binding of all polypeptide variants to human serum albumin (HSA) was investigated. The proteins were diluted to 50 nM in running buffer and injected over a chip surface with 2500 RU of immobilized HSA. The association was studied for 300 s and the dissociation was followed for 7200 s (2 h). For data analysis, all samples were double referenced; the signal from a blank surface was first subtracted from the signal from the respective protein, and secondly the signal from an injection of PBST (running buffer) over the HSA surface was subtracted.

The HSA binding kinetics of PEP18049_CL and the reference protein PEP07830 were further studied using a sensor chip with HSA immobilized on three different surfaces to between 1100 RU and 1600 RU. The proteins were diluted in running buffer (0.8, 1.6, 3.3, and 6.6 nM for PEP18049_CL and 1.0, 2.0, 4.0 and 8.0 nM for PEP07830) and injected over the three HSA surfaces and thus giving binding curves in triplicate. The association time was 300 s and the dissociation was followed for 36 000 s (10 h).

The kinetic parameters of the binding of PEP18049_CL and the reference protein PEP07830 to HSA were obtained from fitting the obtained sensorgrams to a 1:1 Langmuir binding model using the ProteOn Manager software version 3.1.0.6 (Bio-Rad). The average association rate constant ($k_a$ (M$^{-1}$ s$^{-1}$)) and dissociation rate constant ($k_d$ (s$^{-1}$)) with standard deviation were calculated. From the average $k_a$ and the $k_d$ the dissociation equilibrium constant ($K_D$ (M)) was calculated ($K_D=k_d/k_a$).

Results

Figure 5A:
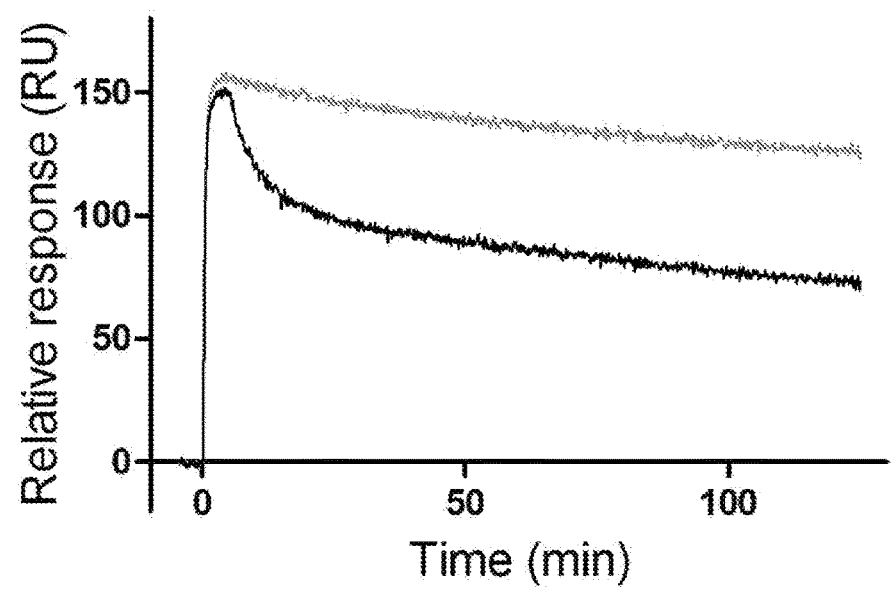
FIG. 5A shows the result of binding analysis by SPR of human serum albumin binding by the crosslinked PEP18049_CL (black) in comparison with the linear reference polypeptide PEP07830 (grey).

HSA binding of the crosslinked polypeptide variants and of the reference protein PEP07830 was analyzed in real time by SPR-based biosensor (ProteOn) experiments. The first screening experiment showed that PEP18049_CL had a fast on-rate and a two phase-like dissociation: a fast and immediate dissociation followed by a much slower dissociation after approximately 30 min (FIG. 5A). PEP18050_CL and PEP18052_CL had completely lost their affinity for HSA, while PEP18053_CL still displayed weak binding. PEP18051_CL showed a slower on-rate, but also seemed to have a very slow off-rate indicating a high affinity for HSA.

Figure 5B:
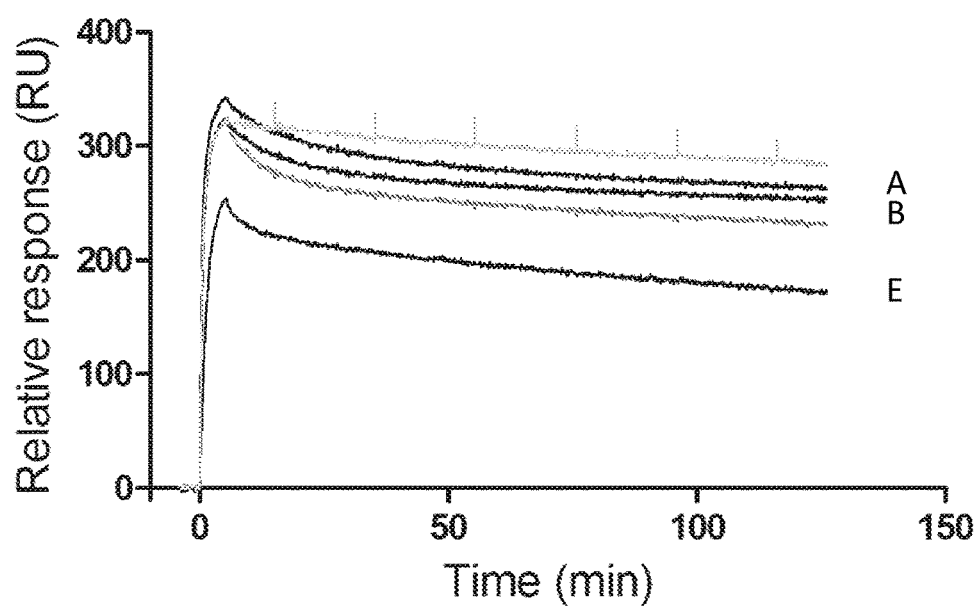
FIG. 5B shows the result of a binding analysis by SPR of human serum albumin binding by the Cys-Cys crosslinked variants PEP14788_CL_A, PEP14788_CL_B and PEP14788_CL_E (shown in black and indicated by A, B and E, respectively) initially produced by chemical synthesis. Albumin binding by PEP18049_CL (dark grey) and the linear reference polypeptide PEP07830 (light grey) are shown for comparison.

In a second screening experiment, the HSA binding of the chemically synthesized PEP14788_CL_A, PEP14788_CL_B, and PEP14788_CL_E were compared to PEP18049_CL (FIG. 5B). All three Cyc-Cys coupled variants showed similar binding affinities for HSA, comparable to PEP18049_CL.

Figure 5C:
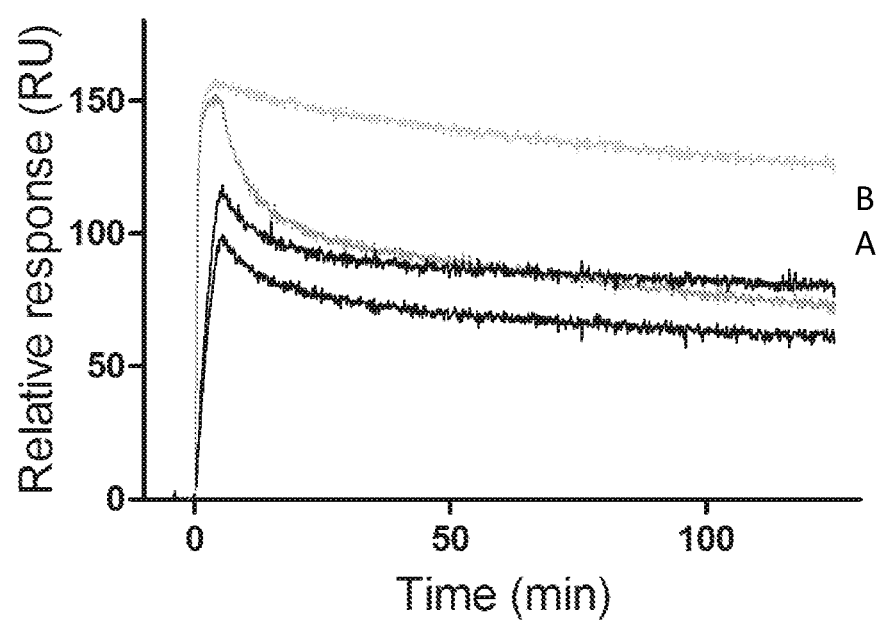
FIG. 5C shows the result of a binding analysis by SPR of human serum albumin binding by the Cys-Cys crosslinked variants PEP14789_CL_A and PEP14789_CL_B (shown in black and indicated by A and B, respectively) initially produced by recombinant expression in *E. coli*. PEP18049_CL (dark grey) and the linear reference polypeptide PEP07830 (light grey) are shown for comparison.

In a third screening experiment, the HSA binding of the recombinantly produced PEP14789_CL_A and PEP14789_CL_B were compared to PEP18049_CL (FIG. 5C). These two variants also showed similar binding affinities for HSA, comparable to PEP18049_CL.

The HSA binding of PEP18049_CL and the reference polypeptide PEP07830 was studied in more detail, but due to extremely slow off-rates it was not possible to use a ProteOn XPR36 for determination of the exact kinetic parameters, including $K_D$ values. Thus, the calculated $K_D$ values (Table 3) can only be used for comparison in this series of experiments. The biosensor experiments were done in triplicates and demonstrated that crosslinked PEP18049_CL binds HSA with a very high affinity ($K_D \approx 24$ pM), which affinity does not differ significantly from the affinity of the linear reference polypeptide PEP07830 ($K_D \approx 21$ pM).

TABLE 4

Relative kinetic parameters for binding of polypeptides to HSA.

| SEQ ID NO of linear polypeptide | Polypeptide variant | $k_a$ ($M^{-1}s^{-1}$) | $k_d$ ($s^{-1}$) | $K_D$ (M) |
|---|---|---|---|---|
| 1 | PEP18049_CL | 6.2(±0.7) × 10$^5$ | 1.5(±0.1) × 10$^{-5}$ | 24 × 10$^{-12}$ |
| 1774 | PEP07830 | 1.9(±0.5) × 10$^5$ | 4.1(±1.1) × 10$^{-6}$ | 21 × 10$^{-12}$ |

EXAMPLE 5

Protease Degradation Analysis

In this Example, the resistance of tested polypeptides to proteolytic cleavage by pepsin alone and by a combination of trypsin and chymotrypsin was analyzed.

Materials and Methods

Proteolytic degradation was studied using pepsin (obtained from porcine gastric mucosa, 3200-4500 U mg$^{-1}$, Sigma) and a mixture of trypsin (obtained from bovine pancreas, ≈37 U mg$^{-1}$, Sigma) and chymotrypsin (obtained from bovine pancreas, ≥40 U mg$^{-1}$, Sigma). In all degradation experiments, 5 µg protein in PBS (pH 7.4) at a concentration of 0.25 mg ml$^{-1}$ (50 µM) was used.

Treatment with Pepsin:

5 µg of each variant was transferred to a microcentrifuge tube. 32 µl 10 mM HCl with pepsin at a concentration of 3.25 µg ml$^{-1}$ or 0.81 µg ml$^{-1}$, resulting in a pH around 2.6 and a final pepsin concentration of 2 µg ml$^{-1}$ to be used for screening experiment and 0.5 µg ml$^{-1}$ for studying the degradation over time. In the screening experiment, the samples were incubated for 10 min at 37° C. before the enzyme was inactivated by addition of 5 µl 0.1 M NaOH, which raised the pH to above 9, and then the sample was put on ice. A reference sample of each protein was inactivated with NaOH before pepsin was added to the tube.

The degradation over time was monitored for PEP18049_CL, PEP14788_CL_A and the reference polypeptide PEP07830 by incubation for 3, 6, 12, 30 or 60 min at 37° C. before inactivation with NaOH. Reference samples, inactivated with NaOH before the pepsin was added to the tube, were incubated likewise.

Treatment with Trypsin and Chymotrypsin:

5 µg of each variant was transferred to a microcentrifuge tube. 32 µl PBS (pH 7.4) with trypsin at a concentration of 4.39 µg ml$^{-1}$ and chymotrypsin at a concentration of 1.95 µg ml$^{-1}$ was added to yield a final concentration of 2.7 µg ml$^{-1}$ of trypsin and 1.2 µg ml$^{-1}$ of chymotrypsin. In the screening experiment, the samples were incubated for 10 min at 37° C. before the enzyme was inactivated by addition of 3 µl 10% TFA and then the sample was put on ice. A reference sample of each protein was inactivated with TFA before the trypsin and chymotrypsin were added to the tube.

The degradation over time was monitored for PEP18049_CL, PEP14788_CL_A and the reference polypeptide PEP07830 by incubation for 3, 6, 12, 30, or 60 min at 37° C. before inactivation with TFA. As above, reference samples, inactivated with TFA before trypsin and chymotrypsin were added to the tube, were incubated likewise.

All samples were analyzed by RP-HPLC using an analytical column (Zorbax 300SB-C18, 4.6×150 mm, 3.5 µm particle size, Agilent Technologies) and a gradient of 15-45% solvent B (solvent A: 0.1% TFA-H$_2$O; solvent B: 0.1% TFA-CH$_3$CN) over 25 min at a flow rate of 1.2 ml min$^{-1}$ and LC-ESI-MS on a 6520 Accurate Mass Q-TOF LC/MS.

The elution peaks containing the intact polypeptides were integrated and the area under curve was calculated. The degradation experiments over time were performed in triplicates. The integrated area of each sample was normalized to the mean area of the t=0 samples of that variant, the mean and standard error of the mean were calculated for each time point.

To quantify the stability improvement of the crosslinked variants, the AUC (area under curve) from the normalized charts was calculated for the three investigated variants. The AUC of the crosslinked variants was then compared to the AUC of the reference polypeptide.

Results

The first screening experiments clearly demonstrated that PEP18049_CL has an increased resistance towards degradation by both pepsin and the combination of trypsin and chymotrypsin compared to the reference polypeptide. None of the other crosslinked variants showed improved protease stability under the experimental conditions used. In the second screening experiments, the protease stability of PEP14788_CL_A, PEP14788_CL_B, and PEP14788_CL_E was compared. This experiment showed that there was no significant difference between these variants.

Figure 6A:
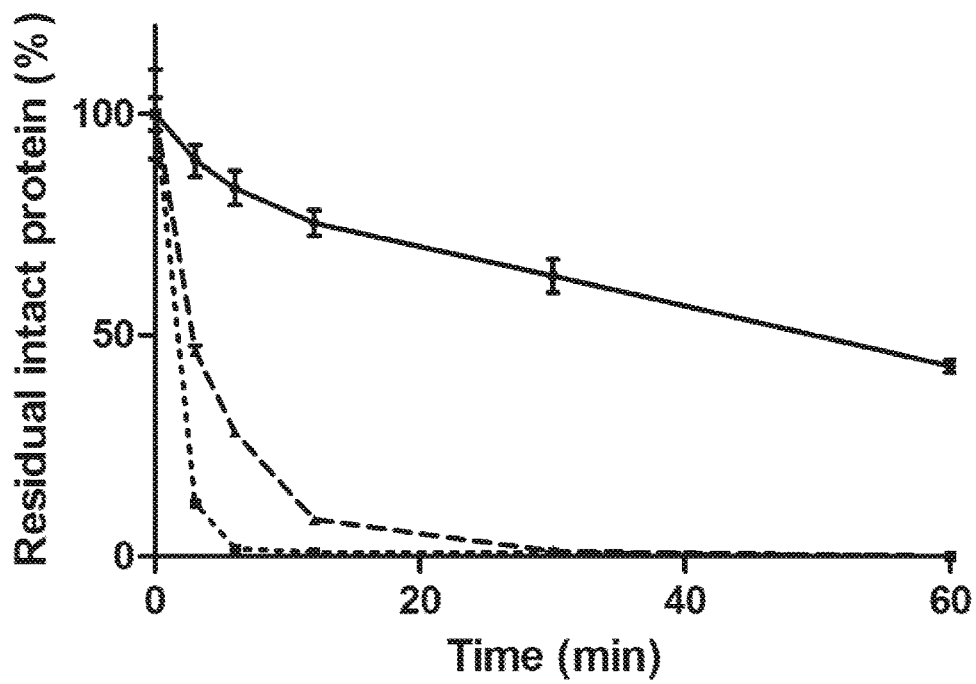
FIG. 6A-B shows the result of the enzyme degradation experiment described in Example 5, using A) pepsin and B) trypsin+chymotrypsin. Normalized amount of residual intact protein of PEP18049_CL (solid line), PEP14788_CL_A (broken line) and PEP07830 (dotted line) is plotted over time.
Figure 6B:
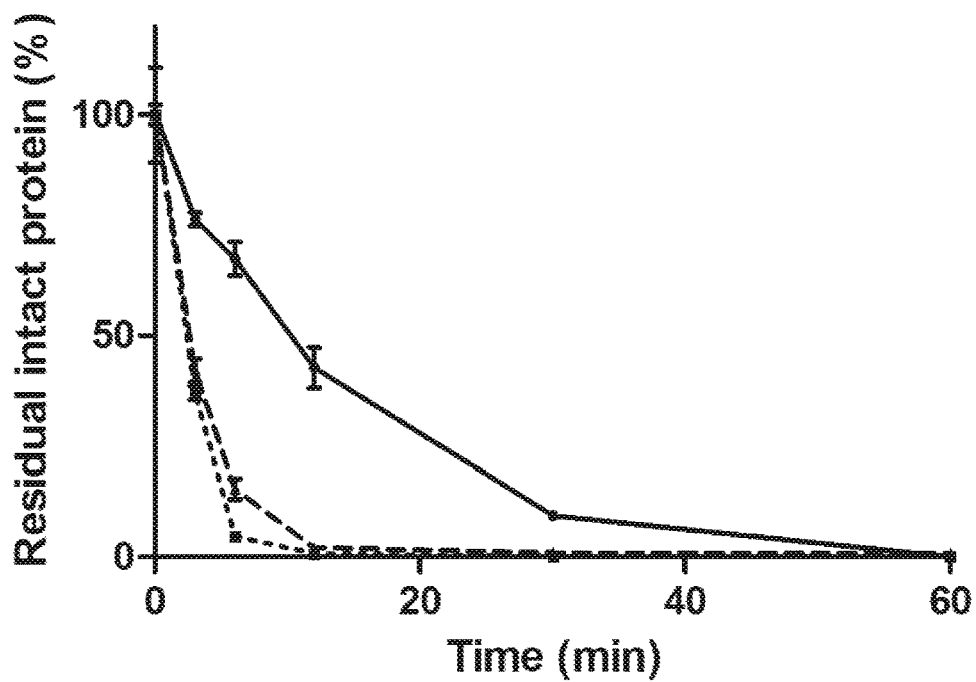

The protease stability of PEP18049_CL, PEP14788_CL_A and the reference polypeptide PEP07830 was studied in further detail and the degradation of the proteins was followed over time. These experiments clearly show that the protease stability of PEP18049_CL compared to the reference protein is significantly improved, in particular the resistance towards degradation by pepsin. A comparison of the area under the curve (AUC) for PEP18049_CL and the reference polypeptide PEP07830 shows that the total amount of full-length protein present during the 60 minutes is at least 17 times (1714%) higher for PEP18049_CL than for PEP07830 when challenged with pepsin and almost 5 (482%) times higher when challenged with trypsin and chymotrypsin (FIG. 6A-B). Also PEP14788_CL_A showed improved stability as compared to PEP07830 as the AUC increased 2.4-fold and 1.4-fold for the pepsin and the combination trypsin and chymotrypsin, respectively.

Investigation of the major degradation products from pepsin degradation of the reference polypeptide PEP07830 showed that the peptide bond between Leu42 and Ala43 is rapidly cleaved, and that this C-terminally truncated protein is the dominating fragment after three minutes of incubation. This 43-residue fragment is then cleaved between Phe20 and Tyr21 giving rise to two new fragments, which are 21 and 22 amino acids long. When PEP07830 was challenged with the combination of trypsin and chymotrypsin, it was shown that the peptide bond between Tyr21 and Lys22 is the most susceptible for cleavage. In addition to cleavage at this position, several peptide fragments formed by cleavage after arginine or lysine residues could be detected. These degradation patterns are in line with the known fact that pepsin preferentially cleaves at Phe, Tyr, Trp and Leu in position P1 or P1', while chymotrypsin preferentially cleaves at Trp, Tyr and Phe in position P1 and trypsin at Arg or Lys at position P1.

To summarize, the crosslinked PEP18049_CL surprisingly showed a dramatic increase in its resistance towards degradation by pepsin (17-fold) and by trypsin together with chymotrypsin (5-fold) compared to the reference polypeptide PEP07830. PEP18049_CL displayed a Tm which was 5° C. higher than that of PEP07830, and an affinity for HSA within the same range, with a $K_D$ value in the low picomolar range (24 pM). A variant of PEP18049 with two cysteines crosslinked with a dihalides (PEP14788_CL_A), which allows for recombinant production (as exemplified herein by PEP14789_CL), showed a high affinity for HSA and an improved resistance towards degradation by pepsin (2.4-fold) and by trypsin together with chymotrypsin (1.4-fold) compared to PEP07830.

ITEMIZED LISTING OF EMBODIMENTS

1. Albumin binding polypeptide comprising an albumin binding motif [ABM], which motif consists of the amino acid sequence (SEQ ID NO. 1782)
$GX_ASDX_5YKX_8X_9I\ X_{11}X_{12}AX_{14}TVEGVX_{20}\ ALX_{23}X_{24}X_{25}ILX_{28}X_{29}X_B$ wherein, independently from each other,
$X_A$ is selected from C and K;
$X_B$ is selected from C and K;
and
$X_5$ is selected from F and Y;
$X_8$ is selected from D, K, N, R and S;
$X_9$ is selected from F, I, L, M, V and Y;
$X_{11}$ is selected from D, E, N and S;
$X_{12}$ is selected from K, N and R;
$X_{14}$ is selected from K and R;
$X_{20}$ is selected from D, E, H, K, N, Q, R and S;
$X_{23}$ is selected from I, K and T;
$X_{24}$ is selected from A, D, E, G, H, L, S and T;
$X_{25}$ is selected from A, D, E and H;
$X_{28}$ is selected from A and K; and
$X_{29}$ is selected from A, E and S.
2. Albumin binding polypeptide according to item 1, wherein $X_A$ is C.
3. Albumin binding polypeptide according to item 1, wherein $X_A$ is K.
4. Albumin binding polypeptide according to any preceding item, wherein $X_B$ is C.
5. Albumin binding polypeptide according to any one of items 1-2, wherein $X_B$ is K.
6. Albumin binding polypeptide according to any one of items 2 and 5, wherein $X_AX_B$ is CK.
7. Albumin binding polypeptide according to any one of items 2 and 4, wherein $X_AX_B$ is CC.
8. Albumin binding polypeptide according to any one of items 3 and 4, wherein $X_AX_B$ is KC.
9. Albumin binding polypeptide according to any one of items 3 and 5, wherein $X_AX_B$ is KK.
10. Albumin binding polypeptide according to any preceding item, wherein $X_5$ is F.
11. Albumin binding polypeptide according to any one of items 1-9, wherein $X_5$ is Y.
12. Albumin binding polypeptide according to any preceding item, wherein $X_5$ is selected from K, N, R and S.
13. Albumin binding polypeptide according to item 12, wherein $X_5$ is selected from N, R and S.
14. Albumin binding polypeptide according to item 12, wherein $X_5$ is selected from K, N and R.
15. Albumin binding polypeptide according to item 13 or 14, wherein $X_5$ is selected from N and R.
16. Albumin binding polypeptide according to item 14, wherein $X_5$ is selected from K and R.
17. Albumin binding polypeptide according to item 15 or 16, wherein $X_5$ is R.
18. Albumin binding polypeptide according to item 15 wherein $X_5$ is N.
19. Albumin binding polypeptide according to item 16, wherein $X_5$ is K.
20. Albumin binding polypeptide according to any preceding item, wherein $X_9$ is L.
21. Albumin binding polypeptide according to any preceding item, wherein $X_{11}$ is selected from D, E and N.
22. Albumin binding polypeptide according to any one of items 1-20, wherein $X_{11}$ is selected from N and S.
23. Albumin binding polypeptide according to item 21 or 22, wherein $X_{11}$ is N.
24. Albumin binding polypeptide according to item 21, wherein $X_{11}$ is selected from D and E.
25. Albumin binding polypeptide according to item 24, wherein $X_{11}$ is D.
26. Albumin binding polypeptide according to item 24, wherein $X_{11}$ is E.
27. Albumin binding polypeptide according to any preceding item, wherein $X_{12}$ is selected from K and N.
28. Albumin binding polypeptide according to any one of items 1-26, wherein $X_{12}$ is selected from K and R.
29. Albumin binding polypeptide according to item 27 or 28, wherein $X_{12}$ is K.
30. Albumin binding polypeptide according to item 27, wherein $X_{12}$ is N.
31. Albumin binding polypeptide according to item 28, wherein $X_{12}$ is R.
32. Albumin binding polypeptide according to any preceding item, wherein $X_{14}$ is K.
33. Albumin binding polypeptide according to any preceding item, wherein $X_{20}$ is selected from D, E, H, N, Q, R and S.
34. Albumin binding polypeptide according to any one of item 1-32, wherein $X_{20}$ is selected from K and E.
35. Albumin binding polypeptide according to item 33 or 34, wherein $X_{20}$ is E.
36. Albumin binding polypeptide according to item 34, wherein $X_{20}$ is K.
37. Albumin binding polypeptide according to any preceding item, wherein $X_{23}$ is selected from I and K.
38. Albumin binding polypeptide according to item 37, wherein $X_{23}$ is I.
39. Albumin binding polypeptide according to item 37, wherein $X_{23}$ is K.
40. Albumin binding polypeptide according to any preceding item, wherein $X_{24}$ is selected from A, D, G, H, L, S and T.
41. Albumin binding polypeptide according to any one of items 1-39, wherein $X_{24}$ is selected from A, E, G, H, L, S and T.

42. Albumin binding polypeptide according to item 40 or 41, wherein $X_{24}$ is selected from A, G, H, L, S and T.

43. Albumin binding polypeptide according to any one of items 1-39, wherein $X_{24}$ is selected from D, E and L, such as selected from D and E.

44. Albumin binding polypeptide according to any one of items 42 and 43, wherein $X_{24}$ is L.

45. Albumin binding polypeptide according to any one of items 40 and 43, wherein $X_{24}$ is D.

46. Albumin binding polypeptide according to any one of items 41 and 43, wherein $X_{24}$ is E.

47. Albumin binding polypeptide according to any preceding item, wherein $X_{25}$ is selected from A, E and H, such as selected from A and H or selected from A and E.

48. Albumin binding polypeptide according to any one of items 1-46, wherein $X_{25}$ is selected from D, E and H.

49. Albumin binding polypeptide according to item 48, wherein $X_{25}$ is selected from D and E.

50. Albumin binding polypeptide according to item 47 or 49, wherein $X_{25}$ is E.

51. Albumin binding polypeptide according to item 47, wherein $X_{25}$ is A.

52. Albumin binding polypeptide according to item 49, wherein $X_{25}$ is D.

53. Albumin binding polypeptide according to item 47 or 48, wherein $X_{25}$ is H.

54. Albumin binding polypeptide according to any preceding item, wherein $X_{28}$ is A.

55. Albumin binding polypeptide according to any preceding item, wherein $X_{29}$ is selected from A and S.

56. Albumin binding polypeptide according to item 55, wherein $X_{29}$ is A.

57. Albumin binding polypeptide according to item 55, wherein $X_{29}$ is S.

58. Albumin binding polypeptide according to any preceding item, wherein said albumin binding motif [ABM] comprises an additional position $X_{31}$ located on the C-terminal side of the ABM.

59. Albumin binding polypeptide according to item 58, wherein $X_{31}$ is P.

60. Albumin binding polypeptide according to any preceding item, in which the [ABM] consists of an amino acid sequence extending from position 16 to position 45 in an amino acid sequence selected from the group consisting of SEQ ID NO:1-1768.

61. Albumin binding polypeptide according to item 60, in which the [ABM] consists of an amino acid sequence extending from position 16 to position 45 in an amino acid sequence selected from the group consisting of SEQ ID NO:1-4.

62. Albumin binding polypeptide according to item 61, in which the [ABM] consists of an amino acid sequence extending from position 16 to position 45 in an amino acid sequence selected from the group consisting of SEQ ID NO:1 and SEQ ID NO:3.

63. Albumin binding polypeptide according to item 62, in which the [ABM] consists of an amino acid sequence extending from position 16 to position 45 in SEQ ID NO:1.

64. Albumin binding polypeptide according to any preceding item, in which said albumin binding motif forms part of a three-helix bundle protein domain.

65. Albumin binding polypeptide according to item 64, in which said three-helix bundle protein domain is selected from the group consisting of three-helix domains of bacterial receptor proteins.

66. Albumin binding polypeptide according to item 65, in which said bacterial receptor protein is selected from the group consisting of albumin binding receptor proteins from species of *Streptococcus, Peptostreptococcus* and *Finegoldia*.

67. Albumin binding polypeptide according to item 66, in which said albumin binding receptor protein is selected from the group consisting of G, MAG, ZAG, PPL and PAB.

68. Albumin binding polypeptide according to item 67, in which said albumin binding receptor protein is protein G.

69. Albumin binding polypeptide according to item 68, in which said albumin binding receptor protein is protein G from *Streptococcus* strain G148.

70. Albumin binding polypeptide according to item 69, in which said three-helix bundle protein domain is selected from the group consisting of domain GA1, domain GA2 and domain GA3 of protein G from *Streptococcus* strain G148, in particular domain GA3 of protein G from *Streptococcus* strain G148.

71. Albumin binding polypeptide according to item 65, in which said bacterial receptor protein is protein A from *Staphylococcus aureus*.

72. Albumin binding polypeptide according to item 71, in which said three-helix bundle protein domain is selected from the group consisting of protein A domains A, B, C, D and E.

73. Albumin binding polypeptide according to item 71, in which said three-helix bundle protein domain is protein Z derived from domain B of protein A from *Staphylococcus aureus*.

74. Albumin binding polypeptide according to item 64, which comprises the amino acid sequence:

$$LAX_aAKX_bX_cAX_dX_eELX_fX_gY\text{-[ABM]} \quad \text{(SEQ ID NO. 1783)}$$

wherein

[ABM] is an albumin binding motif as defined by any one of items 1-63, and, independently of each other, $X_a$ is selected from C, E, Q and S;
$X_b$ is selected from C, E, S and V;
$X_c$ is selected from A, D, E, L and S;
$X_d$ is selected from I, N and L;
$X_e$ is selected from A, K, R and S;
$X_f$ is selected from D and K; and
$X_g$ is selected from A, C, K and S.

75. Albumin binding polypeptide according to item 74, wherein $X_a$ is selected from S and E.

76. Albumin binding polypeptide according to item 75, wherein $X_a$ is S.

77. Albumin binding polypeptide according to item 75, wherein $X_a$ is E.

78. Albumin binding polypeptide according to any one of items 74-77, wherein $X_b$ is selected from C, E and S or alternatively selected from E and V.

79. Albumin binding polypeptide according to item 78, wherein $X_b$ is E.

80. Albumin binding polypeptide according to item 78, wherein $X_b$ is V.

81. Albumin binding polypeptide according to any one of items 74-80, wherein $X_c$ is selected from A and L.

82. Albumin binding polypeptide according to any one of items 74-80, wherein $X_c$ is selected from A and S.

83. Albumin binding polypeptide according to item 81 or 82, wherein $X_c$ is A.

84. Albumin binding polypeptide according to item 81, wherein $X_c$ is L.

85. Albumin binding polypeptide according to any one of items 74-84, wherein $X_d$ is N.

86. Albumin binding polypeptide according to any one of items 74-85, wherein $X_e$ is selected from A and R.

87. Albumin binding polypeptide according to any one of items 74-85, wherein $X_e$ is selected from A and S.

88. Albumin binding polypeptide according to item 86 or 87, wherein $X_e$ is A.

89. Albumin binding polypeptide according to item 86, wherein $X_e$ is R.

90. Albumin binding polypeptide according to item 87, wherein $X_e$ is S.

91. Albumin binding polypeptide according to any one of items 74-90, wherein $X_f$ is D.

92. Albumin binding polypeptide according to any one of items 74-91, wherein $X_g$ is selected from C, K and S.

93. Albumin binding polypeptide according to item 92, wherein $X_g$ is selected from K and S.

94. Albumin binding polypeptide according to item 92, wherein $X_g$ is selected from C and S.

95. Albumin binding polypeptide according to item 93 or 94, wherein $X_g$ is S.

96. Albumin binding polypeptide according to item 93, wherein $X_g$ is K.

97. Albumin binding polypeptide according to item 94, wherein $X_g$ is C.

98. Albumin binding polypeptide according to any one of the preceding items, which comprises an amino acid sequence selected from SEQ ID NO:1-1768.

99. Albumin binding polypeptide according to any one of the preceding items, which comprises an amino acid sequence selected from SEQ ID NO:1-4.

100. Albumin binding polypeptide according to any one of the preceding items, which comprises an amino acid sequence selected from SEQ ID NO:1 and SEQ ID NO:3.

101. Albumin binding polypeptide according to any one of the preceding items, which comprises the amino acid sequence SEQ ID NO:1.

102. Albumin binding polypeptide according to any one of items 1-6 and 8-101, wherein said K in position $X_A$ or $X_B$, when present, is functionalized.

103. Albumin binding polypeptide according to item 102, wherein said functionalized K comprises a haloacetyl group, such as a chloroacetyl group.

104. Albumin binding polypeptide according to any preceding item, wherein said amino acid sequence is cross-linked.

105. Albumin binding polypeptide according to item 104, wherein said crosslink extends between the amino acid residue in position $X_A$ and the amino acid residue in position $X_B$ of said amino acid sequence.

106. Albumin binding polypeptide according to any one of items 104-105, wherein said crosslink is selected from the group comprising thioether bond between a haloacetylated lysine residue and a thiol group of a cysteine residue or thiol-modified lysine residue, thioether bond between a maleimide-functionalized lysine residue and a thiol group of a cysteine residue or thiol-modified lysine residue, thioether bond between a pyridyldithiol-functionalized lysine residue and a thiol group of a cysteine residue or thiol-modified lysine residue, thioether bond between the thiol groups of cysteine residues or thiol-modified lysine residues and a bifunctional dihalogenated linker, thioether bond between the thiol groups of cysteine residues or thiol-modified lysine residues and a bifunctional dimaleimide linker, thioether bond between the thiol groups of cysteine residues or thiol-modified lysine residues and a bifunctional dipyridyldithiol linker, thioether bond between the thiol groups of cysteine residues or thiol-modified lysine residues and a bifunctional perfluoroaromatic linker, disulfide bond between the thiol groups of cysteine residues or thiol-modified lysine residues, oxime bond between an aminooxy-modified amino acid residue and an aldehyde-modified amino acid residue, oxime bond between an aminooxy-modified amino acid residue and a ketone-modified amino acid residue, bond formed by Cu-catalyzed cycloaddition between an azido-modified amino acid residue and an alkyne-modified amino acid residue, bond formed by Staudinger reaction between an azido-modified amino acid residue and a triarylphosphine-modified amino acid residue, and bond formed by native chemical ligation reaction between a thioester-modified amino acid residue and a cysteine-modified amino acid residue.

107. Albumin binding polypeptide according to any one of items 104-106, wherein said crosslink is a thioether bond.

108. Albumin binding polypeptide according to item 107, wherein said crosslink is a thioether bond between a haloacetylated lysine residue and the thiol group of a cysteine residue, such as a thioether bond between a chloroacetylated lysine residue and the thiol group of a cysteine residue.

109. Albumin binding polypeptide according to any one of items 104-106, wherein said crosslink is a disulfide bond.

110. Albumin binding polypeptide according to item 109, wherein said crosslink is a disulfide bond between the thiol groups of two cysteine residues.

111. Albumin binding polypeptide according to item 110, wherein said disulfide bond is obtained by using a dihalide crosslinker.

112. Albumin binding polypeptide according to item 111, wherein said crosslinker is selected from the group consisting of o-xylylene dibromide, m-xylylene dibromide, p-xylylene dibromide, 2,3-bis(bromomethyl)quinoxaline and 2,6-bis(bromomethyl)pyridine.

113. Albumin binding polypeptide according to item 112, wherein said crosslinker is selected from the group consisting of o-xylylene dibromide, m-xylylene dibromide and 2,6-bis(bromomethyl)pyridine.

114. Albumin binding polypeptide according to any one of items 104-113, wherein said albumin binding motif retains a two alpha helix conformation.

115. Albumin binding polypeptide according to any one of items 104-114, wherein said albumin binding polypeptide retains a three-helix bundle conformation.

116. Albumin binding polypeptide according to any one of items 104-115, wherein said polypeptide is resistant to proteolytic cleavage.

117. Albumin binding polypeptide according to item 116, wherein said proteolytic cleavage is by at least one protease of the gastrointestinal tract.

118. Albumin binding polypeptide according to item 117, wherein said at least one protease is selected from pepsin, trypsin, chymotrypsin and combinations thereof.

119. Albumin binding polypeptide according to item 117, wherein said at least one protease is pepsin.

120. Albumin binding polypeptide according to item 117, wherein said at least one protease is trypsin.

121. Albumin binding polypeptide according to item 117, wherein said at least one protease is chymotrypsin.

122. Albumin binding polypeptide according to any one of items 104-121, which exhibits a melting temperature (Tm) of at least 37° C., for example at least 39° C., for example at least 41° C., for example at least 43° C., for example at least 45° C., for example at least 47° C., for example at least 49° C., for example at least 51° C., for example at least 53° C., for example at least 55° C., for example at least 57° C., for example at least 59° C., for example at least 61° C., for example at least 63° C., for example at least 65° C., for example at least 67° C., for example at least 69° C., for example at least 71° C., for example at least 73° C., for example at least 75° C.

123. Albumin binding polypeptide according to any preceding item, which binds to albumin such that the $K_D$ value of the interaction is at most $1 \times 10^{-8}$ M, such as at most $1 \times 10^{-9}$ M, such as at most $1 \times 10^{-10}$ M, such as at most $1 \times 10^{-11}$ M, such as at most $1 \times 10^{-12}$ M.

124. Albumin binding polypeptide according to any preceding item, wherein said albumin is human serum albumin.

125. Compound comprising:
at least one moiety (I) which is an albumin binding polypeptide according to any one of the preceding items;
one moiety (II) which confers a desired therapeutic activity; and
optionally, at least one further moiety (III) which confers a desired therapeutic activity, which activity may be the same or different from said activity of moiety (II).

126. Compound according to item 125, in which moiety (II) and/or at least one further moiety (III) comprise a component selected from the group consisting of human endogenous enzymes, hormones, growth factors, chemokines, cytokines, blood clotting and complement factors, innate immune defense and regulatory peptides, for example selected from the group consisting of insulin, insulin analogs, IL-2, IL-5, GLP-1, BNP, IL 1-RA, KGF, STEMGEN, GH, G-CSF, CTLA-4, myostatin, Factor VII, Factor VIII and Factor IX, and derivatives of anyone thereof.

127. Compound according to any one of items 125-126, in which moiety (II) and/or at least one further moiety (III) comprise a non-human biologically active protein, selected from the group consisting of modulins, bacterial toxins, hormones, innate immune defense and regulatory peptides, enzymes and activating proteins.

128. Compound according to any one of items 125-127, in which moiety (II) and/or at least one further moiety (III) comprise a binding polypeptide capable of selective interaction with a target molecule.

129. Compound according to item 128, in which the binding polypeptide is selected from the group consisting of antibodies and fragments and domains thereof substantially retaining antibody binding activity; microbodies, maxybodies, avimers and other small disulfide-bonded proteins; and binding proteins derived from a scaffold selected from the group consisting of staphylococcal protein A and domains thereof, other three helix domains, lipocalins, ankyrin repeat domains, cellulose binding domains, γ crystallines, green fluorescent protein, human cytotoxic T lymphocyte-associated antigen 4, protease inhibitors such as Kunitz domains, PDZ domains, SH3 domains, peptide aptamers, staphylococcal nuclease, tendamistats, fibronectin type III domain, transferrin, zinc fingers and conotoxins.

130. Compound according to item 129, in which said binding polypeptide comprises a variant of protein Z derived from domain B of staphylococcal protein A, which variant comprises a scaffold amino acid sequence selected from SEQ ID NO:1775-1781, wherein X denotes any amino acid residue.

131. Compound according to any one of items 128-130, in which said target molecule is selected from the group consisting of tumor-related or other cell surface related antigens, such as CD14, CD19, CD20, CD22, CD30, CD33, CD37, CD40, CD52, CD56, CD70, CD138, cMet, HER1, HER2, HER3, HER4, CAIX, CEA, IL-2 receptor, IGF1R, VEGFR2, FcRn, MUC1, PDGFR-beta, PSMA, TAG-72, FOLR1, mesothelin, CA6, GPNMB, integrins and ephA2; cytokines such as TNF-α, IL-la, IL-1β, IL-1Ra, IL-5, IL-6, IL-13, IL-17A, IL-18, IL-23, IL-36, G-CSF, GM-CSF, and their receptors; chemokines such as IL-8, CCL-2 and CCL11, and their receptors; complement factors such as C3, C5 and factor D; growth factors such as HGF and myostatin; hormones such as GH, insulin and somatostatin; peptides such as Aβ peptide of Alzheimer's disease; other disease-associated amyloid peptides; hypersensitivity mediators such as histamine and IgE, immunoglobulins such as IgG; blood clotting factors, such as von Willebrand factor; and toxins, such as bacterial toxins and snake venoms.

132. Compound according to item 125, in which moiety (II) and/or at least one further moiety (III) comprise a non-proteinaceous component selected from the group consisting of a) cytotoxic agents, for example calicheamycin, auristatin, doxorubicin, maytansinoid, taxane, ecteinascidin, geldanamycin, methotrexate, camptothecin, cyclophosphamide, cyclosporine and their derivatives, and combinations thereof; and b) anti-inflammatory agents, for example non-steroidal anti-inflammatory drugs, cytokine suppressive anti-inflammatory drugs, corticosteroids, methotrexate, prednisone, cyclosporine, morroniside cinnamic acid, leflunomide and their derivatives, and combinations thereof.

133. Pharmaceutical composition, comprising a compound according to any one of items 125-132 and at least one pharmaceutically acceptable excipient.

134. Pharmaceutical composition according to item 133, which further comprises at least one component for increasing oral bioavailability of said therapeutic activity.

135. Pharmaceutical composition according to item 134, wherein said component is selected from the group consisting of protease inhibitors, absorbance enhancers, mucoadhesive polymers, formulation vehicles and any combination thereof.

136. Pharmaceutical composition according to any one of items 133-135, which is present in a form selected from solid forms, such as pills, tablets, capsules, powders or granules; semi-solid forms, such as pastes; and liquid forms, such as elixirs, solutions or suspensions.

137. Pharmaceutical composition according to any one of items 133-136, in a formulation designed for immediate, delayed or controlled release.

138. Pharmaceutical composition according to any one of items 133-137, formulated as enteric-coated capsules.

139. Albumin binding polypeptide according to any one of items 1-124, compound according to any one of items 125-132 or pharmaceutical composition according to any one of items 133-138 for use in treatment.

140. Albumin binding polypeptide, compound or pharmaceutical composition for use according to item 139, wherein said treatment is via oral administration.

141. Albumin binding polypeptide, compound or pharmaceutical composition for use according to any one of items 139 and 140, wherein said treatment is carried out according to a specified dosage regime.

142. Method of treatment of a mammalian subject in need of such treatment, comprising administration of a therapeutically effective amount of an albumin binding polypeptide according to any one of items 1-124, compound according to any one of items 125-132 or pharmaceutical composition according to any one of items 133-138.

143. Method according to item 142, wherein said administration is oral administration.

144. Method according to any one of items 142-143, wherein said compound or pharmaceutical composition is carried out according to a specified dosage regime.

SEQUENCE LISTING (1783 sequences)

SEQ ID NO: 1 - protein, 46 aa, ARTIFICIAL SEQUENCE
  Engineered albumin binding polypeptide
LAEAKEAANAELDSYGCSDFYKRLIDKAKTVEGVEALKDAILAAKP

SEQ ID NO: 2 - protein, 46 aa, ARTIFICIAL SEQUENCE
  Engineered albumin binding polypeptide
LAEAKEAANAELDSYGKSDFYKRLIDKAKTVEGVEALKDAILAACP

SEQ ID NO: 3 - protein, 46 aa, ARTIFICIAL SEQUENCE
  Engineered albumin binding polypeptide
LAEAKEAANAELDSYGCSDFYKRLIDKAKTVEGVEALKDAILAACP

SEQ ID NO: 4 - protein, 46 aa, ARTIFICIAL SEQUENCE
  Engineered albumin binding polypeptide
LAEAKEAANAELDSYGKSDFYKRLIDKAKTVEGVEALKDAILAAKP

SEQ ID NO: 5 - protein, 46 aa, ARTIFICIAL SEQUENCE
  Engineered albumin binding polypeptide
LAEAKVLANRELDKYGCSDFYKNLINRAKTVEGVHALIGHILAAKP

SEQ ID NO: 6 - protein, 46 aa, ARTIFICIAL SEQUENCE
  Engineered albumin binding polypeptide
LAEAKVLANRELDKYGKSDFYKNLINRAKTVEGVHALIGHILAACP

SEQ ID NO: 7 - protein, 46 aa, ARTIFICIAL SEQUENCE
  Engineered albumin binding polypeptide
LAEAKVLANRELDKYGCSDFYKNLINRAKTVEGVHALIGHILAACP

SEQ ID NO: 8 - protein, 46 aa, ARTIFICIAL SEQUENCE
  Engineered albumin binding polypeptide
LAEAKVLANRELDKYGKSDFYKNLINRAKTVEGVHALIGHILAAKP

SEQ ID NO: 9 - protein, 46 aa, ARTIFICIAL SEQUENCE
  Engineered albumin binding polypeptide
LAEAKVLANRELDKYGCSDFYKNVINRAKTVEGVHALIDHILAAKP

SEQ ID NO: 10 - protein, 46 aa, ARTIFICIAL SEQUENCE
  Engineered albumin binding polypeptide
LAEAKVLANRELDKYGKSDFYKNVINRAKTVEGVHALIDHILAACP

SEQ ID NO: 11 - protein, 46 aa, ARTIFICIAL SEQUENCE
  Engineered albumin binding polypeptide
LAEAKVLANRELDKYGCSDFYKNVINRAKTVEGVHALIDHILAACP

SEQ ID NO: 12 - protein, 46 aa, ARTIFICIAL SEQUENCE
  Engineered albumin binding polypeptide
LAEAKVLANRELDKYGKSDFYKNVINRAKTVEGVHALIDHILAAKP

SEQ ID NO: 13 - protein, 46 aa, ARTIFICIAL SEQUENCE
  Engineered albumin binding polypeptide
LAEAKVLANRELDKYGCSDYYKNIINRAKTVEGVRALKLHILAAKP

SEQ ID NO: 14 - protein, 46 aa, ARTIFICIAL SEQUENCE
  Engineered albumin binding polypeptide
LAEAKVLANRELDKYGKSDYYKNIINRAKTVEGVRALKLHILAACP

SEQ ID NO: 15 - protein, 46 aa, ARTIFICIAL SEQUENCE
  Engineered albumin binding polypeptide
LAEAKVLANRELDKYGCSDYYKNIINRAKTVEGVRALKLHILAACP

SEQ ID NO: 16 - protein, 46 aa, ARTIFICIAL SEQUENCE
  Engineered albumin binding polypeptide
LAEAKVLANRELDKYGKSDYYKNIINRAKTVEGVRALKLHILAAKP

SEQ ID NO: 17 - protein, 46 aa, ARTIFICIAL SEQUENCE
  Engineered albumin binding polypeptide
LAEAKVLANRELDKYGCSDFYKNVINRAKTVEGVSALIHEILAAKP

SEQ ID NO: 18 - protein, 46 aa, ARTIFICIAL SEQUENCE
  Engineered albumin binding polypeptide
LAEAKVLANRELDKYGKSDFYKNVINRAKTVEGVSALIHEILAACP

SEQ ID NO: 19 - protein, 46 aa, ARTIFICIAL SEQUENCE
  Engineered albumin binding polypeptide
LAEAKVLANRELDKYGCSDFYKNVINRAKTVEGVSALIHEILAACP

SEQ ID NO: 20 - protein, 46 aa, ARTIFICIAL SEQUENCE
  Engineered albumin binding polypeptide
LAEAKVLANRELDKYGKSDFYKNVINRAKTVEGVSALIHEILAAKP

SEQ ID NO: 21 - protein, 46 aa, ARTIFICIAL SEQUENCE
  Engineered albumin binding polypeptide
LAEAKVLANRELDKYGCSDFYKRLINRAKTVEGVNTLIADILAAKP

SEQ ID NO: 22 - protein, 46 aa, ARTIFICIAL SEQUENCE
  Engineered albumin binding polypeptide
LAEAKVLANRELDKYGKSDFYKRLINRAKTVEGVNTLIADILAACP

SEQ ID NO: 23 - protein, 46 aa, ARTIFICIAL SEQUENCE
  Engineered albumin binding polypeptide
LAEAKVLANRELDKYGCSDFYKRLINRAKTVEGVNTLIADILAACP

SEQ ID NO: 24 - protein, 46 aa, ARTIFICIAL SEQUENCE
  Engineered albumin binding polypeptide
LAEAKVLANRELDKYGKSDFYKRLINRAKTVEGVNTLIADILAAKP

SEQ ID NO: 25 - protein, 46 aa, ARTIFICIAL SEQUENCE
  Engineered albumin binding polypeptide
LAEAKVLANRELDKYGCSDFYKNLINRAKTVEGVNTLIADILAAKP

SEQ ID NO: 26 - protein, 46 aa, ARTIFICIAL SEQUENCE
  Engineered albumin binding polypeptide
LAEAKVLANRELDKYGKSDFYKNLINRAKTVEGVNTLIADILAACP

SEQ ID NO: 27 - protein, 46 aa, ARTIFICIAL SEQUENCE
  Engineered albumin binding polypeptide
LAEAKVLANRELDKYGCSDFYKNLINRAKTVEGVNTLIADILAACP

SEQ ID NO: 28 - protein, 46 aa, ARTIFICIAL SEQUENCE
  Engineered albumin binding polypeptide
LAEAKVLANRELDKYGKSDFYKNLINRAKTVEGVNTLIADILAAKP

SEQ ID NO: 29 - protein, 46 aa, ARTIFICIAL SEQUENCE
  Engineered albumin binding polypeptide
LAEAKVLANRELDKYGCSDYYKNLINRAKTVEGVNSLISHILAAKP

SEQ ID NO: 30 - protein, 46 aa, ARTIFICIAL SEQUENCE
  Engineered albumin binding polypeptide
LAEAKVLANRELDKYGKSDYYKNLINRAKTVEGVNSLISHILAACP

SEQ ID NO: 31 - protein, 46 aa, ARTIFICIAL SEQUENCE
  Engineered albumin binding polypeptide
LAEAKVLANRELDKYGCSDYYKNLINRAKTVEGVNSLISHILAACP

SEQ ID NO: 32 - protein, 46 aa, ARTIFICIAL SEQUENCE
  Engineered albumin binding polypeptide
LAEAKVLANRELDKYGKSDYYKNLINRAKTVEGVNSLISHILAAKP

SEQ ID NO: 33 - protein, 46 aa, ARTIFICIAL SEQUENCE
  Engineered albumin binding polypeptide
LAEAKVLANRELDKYGCSDFYKRLINRAKTVGGVQSLISEILAAKP

SEQ ID NO: 34 - protein, 46 aa, ARTIFICIAL SEQUENCE
  Engineered albumin binding polypeptide
LAEAKVLANRELDKYGKSDFYKRLINRAKTVGGVQSLISEILAACP

SEQ ID NO: 35 - protein, 46 aa, ARTIFICIAL SEQUENCE
  Engineered albumin binding polypeptide
LAEAKVLANRELDKYGCSDFYKRLINRAKTVGGVQSLISEILAACP

SEQ ID NO: 36 - protein, 46 aa, ARTIFICIAL SEQUENCE
  Engineered albumin binding polypeptide
LAEAKVLANRELDKYGKSDFYKRLINRAKTVGGVQSLISEILAAKP

SEQ ID NO: 37 - protein, 46 aa, ARTIFICIAL SEQUENCE
  Engineered albumin binding polypeptide
LAEAKVLANRELDKYGCSDFYKNLINRAKTVEGVSSLKGHILAAKP

SEQ ID NO: 38 - protein, 46 aa, ARTIFICIAL SEQUENCE
  Engineered albumin binding polypeptide
LAEAKVLANRELDKYGKSDFYKNLINRAKTVEGVSSLKGHILAACP

SEQ ID NO: 39 - protein, 46 aa, ARTIFICIAL SEQUENCE
  Engineered albumin binding polypeptide
LAEAKVLANRELDKYGCSDFYKNLINRAKTVEGVSSLKGHILAACP

SEQ ID NO: 40 - protein, 46 aa, ARTIFICIAL SEQUENCE
  Engineered albumin binding polypeptide
LAEAKVLANRELDKYGKSDFYKNLINRAKTVEGVSSLKGHILAAKP

SEQ ID NO: 41 - protein, 46 aa, ARTIFICIAL SEQUENCE
  Engineered albumin binding polypeptide
LAEAKVLANRELDKYGCSDFYKNVINRAKTVEGVDSLIAEILAAKP

SEQ ID NO: 42 - protein, 46 aa, ARTIFICIAL SEQUENCE
  Engineered albumin binding polypeptide
LAEAKVLANRELDKYGKSDFYKNVINRAKTVEGVDSLIAEILAACP

SEQ ID NO: 43 - protein, 46 aa, ARTIFICIAL SEQUENCE
  Engineered albumin binding polypeptide
LAEAKVLANRELDKYGCSDFYKNVINRAKTVEGVDSLIAEILAACP

SEQ ID NO: 44 - protein, 46 aa, ARTIFICIAL SEQUENCE
  Engineered albumin binding polypeptide
LAEAKVLANRELDKYGKSDFYKNVINRAKTVEGVDSLIAEILAAKP

SEQ ID NO: 45 - protein, 46 aa, ARTIFICIAL SEQUENCE
  Engineered albumin binding polypeptide
LAEAKVLANRELDKYGCSDFYKNLINRARTVEGVQTLISDILAAKP

SEQ ID NO: 46 - protein, 46 aa, ARTIFICIAL SEQUENCE
  Engineered albumin binding polypeptide
LAEAKVLANRELDKYGKSDFYKNLINRARTVEGVQTLISDILAACP

SEQ ID NO: 47 - protein, 46 aa, ARTIFICIAL SEQUENCE
  Engineered albumin binding polypeptide
LAEAKVLANRELDKYGCSDFYKNLINRARTVEGVQTLISDILAACP

SEQ ID NO: 48 - protein, 46 aa, ARTIFICIAL SEQUENCE
  Engineered albumin binding polypeptide
LAEAKVLANRELDKYGKSDFYKNLINRARTVEGVQTLISDILAAKP

SEQ ID NO: 49 - protein, 46 aa, ARTIFICIAL SEQUENCE
  Engineered albumin binding polypeptide
LAEAKVLANRELDKYGCSDFYKKFINKAKTVEGVETLISEILAAKP

SEQ ID NO: 50 - protein, 46 aa, ARTIFICIAL SEQUENCE
  Engineered albumin binding polypeptide
LAEAKVLANRELDKYGKSDFYKKFINKAKTVEGVETLISEILAACP

SEQ ID NO: 51 - protein, 46 aa, ARTIFICIAL SEQUENCE
  Engineered albumin binding polypeptide
LAEAKVLANRELDKYGCSDFYKKFINKAKTVEGVETLISEILAACP

SEQ ID NO: 52 - protein, 46 aa, ARTIFICIAL SEQUENCE
  Engineered albumin binding polypeptide
LAEAKVLANRELDKYGKSDFYKKFINKAKTVEGVETLISEILAAKP

SEQ ID NO: 53 - protein, 46 aa, ARTIFICIAL SEQUENCE
  Engineered albumin binding polypeptide
LAEAKVLANRELDKYGCSDFYKSLINRAKTVEGVHSLTDEILAAKP

SEQ ID NO: 54 - protein, 46 aa, ARTIFICIAL SEQUENCE
  Engineered albumin binding polypeptide
LAEAKVLANRELDKYGKSDFYKSLINRAKTVEGVHSLTDEILAACP

SEQ ID NO: 55 - protein, 46 aa, ARTIFICIAL SEQUENCE
  Engineered albumin binding polypeptide
LAEAKVLANRELDKYGCSDFYKSLINRAKTVEGVHSLTDEILAACP

SEQ ID NO: 56 - protein, 46 aa, ARTIFICIAL SEQUENCE
  Engineered albumin binding polypeptide
LAEAKVLANRELDKYGKSDFYKSLINRAKTVEGVHSLTDEILAAKP

SEQ ID NO: 57 - protein, 46 aa, ARTIFICIAL SEQUENCE
  Engineered albumin binding polypeptide
LAEAKVLANRELDKYGCSDYYKNVINKAKTVEGVSSLTAEILAAKP

SEQ ID NO: 58 - protein, 46 aa, ARTIFICIAL SEQUENCE
  Engineered albumin binding polypeptide
LAEAKVLANRELDKYGKSDYYKNVINKAKTVEGVSSLTAEILAACP

SEQ ID NO: 59 - protein, 46 aa, ARTIFICIAL SEQUENCE
  Engineered albumin binding polypeptide
LAEAKVLANRELDKYGCSDYYKNVINKAKTVEGVSSLTAEILAACP

SEQ ID NO: 60 - protein, 46 aa, ARTIFICIAL SEQUENCE
  Engineered albumin binding polypeptide
LAEAKVLANRELDKYGKSDYYKNVINKAKTVEGVSSLTAEILAAKP

SEQ ID NO: 61 - protein, 46 aa, ARTIFICIAL SEQUENCE
  Engineered albumin binding polypeptide
LAEAKVLANRELDKYGCSDFYKSLINRAKTVEGVDALTSHILAAKP

SEQ ID NO: 62 - protein, 46 aa, ARTIFICIAL SEQUENCE
  Engineered albumin binding polypeptide
LAEAKVLANRELDKYGKSDFYKSLINRAKTVEGVDALTSHILAACP

SEQ ID NO: 63 - protein, 46 aa, ARTIFICIAL SEQUENCE
  Engineered albumin binding polypeptide
LAEAKVLANRELDKYGCSDFYKSLINRAKTVEGVDALTSHILAACP

SEQ ID NO: 64 - protein, 46 aa, ARTIFICIAL SEQUENCE
  Engineered albumin binding polypeptide
LAEAKVLANRELDKYGKSDFYKSLINRAKTVEGVDALTSHILAAKP

SEQ ID NO: 65 - protein, 46 aa, ARTIFICIAL SEQUENCE
  Engineered albumin binding polypeptide
LAEAKVLANRELDKYGCSDFYKNLINKAKTVEGVSTLIHDILAAKP

SEQ ID NO: 66 - protein, 46 aa, ARTIFICIAL SEQUENCE
  Engineered albumin binding polypeptide
LAEAKVLANRELDKYGKSDFYKNLINKAKTVEGVSTLIHDILAACP

SEQ ID NO: 67 - protein, 46 aa, ARTIFICIAL SEQUENCE
  Engineered albumin binding polypeptide
LAEAKVLANRELDKYGCSDFYKNLINKAKTVEGVSTLIHDILAACP

SEQ ID NO: 68 - protein, 46 aa, ARTIFICIAL SEQUENCE
  Engineered albumin binding polypeptide
LAEAKVLANRELDKYGKSDFYKNLINKAKTVEGVSTLIHDILAAKP

SEQ ID NO: 69 - protein, 46 aa, ARTIFICIAL SEQUENCE
  Engineered albumin binding polypeptide
LAEAKVLANRELDKYGCSDFYKNLINRAKTVEGVSTLIHDILAAKP

SEQ ID NO: 70 - protein, 46 aa, ARTIFICIAL SEQUENCE
  Engineered albumin binding polypeptide
LAEAKVLANRELDKYGKSDFYKNLINRAKTVEGVSTLIHDILAACP

SEQ ID NO: 71 - protein, 46 aa, ARTIFICIAL SEQUENCE
  Engineered albumin binding polypeptide
LAEAKVLANRELDKYGCSDFYKNLINRAKTVEGVSTLIHDILAACP

SEQ ID NO: 72 - protein, 46 aa, ARTIFICIAL SEQUENCE
  Engineered albumin binding polypeptide
LAEAKVLANRELDKYGKSDFYKNLINRAKTVEGVSTLIHDILAAKP

SEQ ID NO: 73 - protein, 46 aa, ARTIFICIAL SEQUENCE
  Engineered albumin binding polypeptide
LAEAKVLANRELDKYGCSDFYKNLINRAKTVEGVQALISEILAAKP

SEQ ID NO: 74 - protein, 46 aa, ARTIFICIAL SEQUENCE
  Engineered albumin binding polypeptide
LAEAKVLANRELDKYGKSDFYKNLINRAKTVEGVQALISEILAACP

SEQ ID NO: 75 - protein, 46 aa, ARTIFICIAL SEQUENCE
  Engineered albumin binding polypeptide
LAEAKVLANRELDKYGCSDFYKNLINRAKTVEGVQALISEILAACP

SEQ ID NO: 76 - protein, 46 aa, ARTIFICIAL SEQUENCE
  Engineered albumin binding polypeptide
LAEAKVLANRELDKYGKSDFYKNLINRAKTVEGVQALISEILAAKP

SEQ ID NO: 77 - protein, 46 aa, ARTIFICIAL SEQUENCE
  Engineered albumin binding polypeptide
LAEAKVLANRELDKYGCSDYYKSLINKAKTVEGVDSLIVHILAAKP

SEQ ID NO: 78 - protein, 46 aa, ARTIFICIAL SEQUENCE
  Engineered albumin binding polypeptide
LAEAKVLANRELDKYGKSDYYKSLINKAKTVEGVDSLIVHILAACP

SEQ ID NO: 79 - protein, 46 aa, ARTIFICIAL SEQUENCE
  Engineered albumin binding polypeptide
LAEAKVLANRELDKYGCSDYYKSLINKAKTVEGVDSLIVHILAACP

SEQ ID NO: 80 - protein, 46 aa, ARTIFICIAL SEQUENCE
  Engineered albumin binding polypeptide
LAEAKVLANRELDKYGKSDYYKSLINKAKTVEGVDSLIVHILAAKP

SEQ ID NO: 81 - protein, 46 aa, ARTIFICIAL SEQUENCE
  Engineered albumin binding polypeptide
LAEAKVLANRELDKYGCSDFYKNLINRAKTVEGVQSLITEILAAKP

SEQ ID NO: 82 - protein, 46 aa, ARTIFICIAL SEQUENCE
  Engineered albumin binding polypeptide
LAEAKVLANRELDKYGKSDFYKNLINRAKTVEGVQSLITEILAACP

SEQ ID NO: 83 - protein, 46 aa, ARTIFICIAL SEQUENCE
  Engineered albumin binding polypeptide
LAEAKVLANRELDKYGCSDFYKNLINRAKTVEGVQSLITEILAACP

SEQ ID NO: 84 - protein, 46 aa, ARTIFICIAL SEQUENCE
  Engineered albumin binding polypeptide
LAEAKVLANRELDKYGKSDFYKNLINRAKTVEGVQSLITEILAAKP

SEQ ID NO: 85 - protein, 46 aa, ARTIFICIAL SEQUENCE
  Engineered albumin binding polypeptide
LAEAKVLANRELDKYGCSDYYKNLINRAKTVEGVDALITHILAAKP

SEQ ID NO: 86 - protein, 46 aa, ARTIFICIAL SEQUENCE
  Engineered albumin binding polypeptide
LAEAKVLANRELDKYGKSDYYKNLINRAKTVEGVDALITHILAACP

SEQ ID NO: 87 - protein, 46 aa, ARTIFICIAL SEQUENCE
  Engineered albumin binding polypeptide
LAEAKVLANRELDKYGCSDYYKNLINRAKTVEGVDALITHILAACP

SEQ ID NO: 88 - protein, 46 aa, ARTIFICIAL SEQUENCE
  Engineered albumin binding polypeptide
LAEAKVLANRELDKYGKSDYYKNLINRAKTVEGVDALITHILAAKP

SEQ ID NO: 89 - protein, 46 aa, ARTIFICIAL SEQUENCE
  Engineered albumin binding polypeptide
LAEAKVLANRELDKYGCSDFYKSMINRAKTVEGVDSLITHILAAKP

SEQ ID NO: 90 - protein, 46 aa, ARTIFICIAL SEQUENCE
  Engineered albumin binding polypeptide
LAEAKVLANRELDKYGKSDFYKSMINRAKTVEGVDSLITHILAACP

SEQ ID NO: 91 - protein, 46 aa, ARTIFICIAL SEQUENCE
  Engineered albumin binding polypeptide
LAEAKVLANRELDKYGCSDFYKSMINRAKTVEGVDSLITHILAACP

SEQ ID NO: 92 - protein, 46 aa, ARTIFICIAL SEQUENCE
  Engineered albumin binding polypeptide
LAEAKVLANRELDKYGKSDFYKSMINRAKTVEGVDSLITHILAAKP

SEQ ID NO: 93 - protein, 46 aa, ARTIFICIAL SEQUENCE
  Engineered albumin binding polypeptide
LAEAKVLANRELDKYGCSDFYKNLINRAKTVEGVTTLTTDILAAKP

SEQ ID NO: 94 - protein, 46 aa, ARTIFICIAL SEQUENCE
  Engineered albumin binding polypeptide
LAEAKVLANRELDKYGKSDFYKNLINRAKTVEGVTTLTTDILAACP

SEQ ID NO: 95 - protein, 46 aa, ARTIFICIAL SEQUENCE
  Engineered albumin binding polypeptide
LAEAKVLANRELDKYGCSDFYKNLINRAKTVEGVTTLTTDILAACP

SEQ ID NO: 96 - protein, 46 aa, ARTIFICIAL SEQUENCE
  Engineered albumin binding polypeptide
LAEAKVLANRELDKYGKSDFYKNLINRAKTVEGVTTLTTDILAAKP

SEQ ID NO: 97 - protein, 46 aa, ARTIFICIAL SEQUENCE
  Engineered albumin binding polypeptide
LAEAKVLANRELDKYGCSDFYKNLINRAKTVEGVESLIDHILAAKP

SEQ ID NO: 98 - protein, 46 aa, ARTIFICIAL SEQUENCE
  Engineered albumin binding polypeptide
LAEAKVLANRELDKYGKSDFYKNLINRAKTVEGVESLIDHILAACP

SEQ ID NO: 99 - protein, 46 aa, ARTIFICIAL SEQUENCE
  Engineered albumin binding polypeptide
LAEAKVLANRELDKYGCSDFYKNLINRAKTVEGVESLIDHILAACP

SEQ ID NO: 100 - protein, 46 aa, ARTIFICIAL SEQUENCE
  Engineered albumin binding polypeptide
LAEAKVLANRELDKYGKSDFYKNLINRAKTVEGVESLIDHILAAKP

SEQ ID NO: 101 - protein, 46 aa, ARTIFICIAL SEQUENCE
  Engineered albumin binding polypeptide
LAEAKVLANRELDKYGCSDFYKSYINRAKTVEGVHTLIGHILAAKP

SEQ ID NO: 102 - protein, 46 aa, ARTIFICIAL SEQUENCE
  Engineered albumin binding polypeptide
LAEAKVLANRELDKYGKSDFYKSYINRAKTVEGVHTLIGHILAACP

SEQ ID NO: 103 - protein, 46 aa, ARTIFICIAL SEQUENCE
  Engineered albumin binding polypeptide
LAEAKVLANRELDKYGCSDFYKSYINRAKTVEGVHTLIGHILAACP

SEQ ID NO: 104 - protein, 46 aa, ARTIFICIAL SEQUENCE
  Engineered albumin binding polypeptide
LAEAKVLANRELDKYGKSDFYKSYINRAKTVEGVHTLIGHILAAKP

SEQ ID NO: 105 - protein, 46 aa, ARTIFICIAL SEQUENCE
  Engineered albumin binding polypeptide
LAEAKVLANRELDKYGCSDFYKNLINRAKTVEGVQTLISDILAAKP

SEQ ID NO: 106 - protein, 46 aa, ARTIFICIAL SEQUENCE
  Engineered albumin binding polypeptide
LAEAKVLANRELDKYGKSDFYKNLINRAKTVEGVQTLISDILAACP

SEQ ID NO: 107 - protein, 46 aa, ARTIFICIAL SEQUENCE
  Engineered albumin binding polypeptide
LAEAKVLANRELDKYGCSDFYKNLINRAKTVEGVQTLISDILAACP

SEQ ID NO: 108 - protein, 46 aa, ARTIFICIAL SEQUENCE
  Engineered albumin binding polypeptide
LAEAKVLANRELDKYGKSDFYKNLINRAKTVEGVQTLISDILAAKP

SEQ ID NO: 109 - protein, 46 aa, ARTIFICIAL SEQUENCE
  Engineered albumin binding polypeptide
LAEAKVLANRELDKYGCSDFYKNLINRAKTVEGVNSLTSHILAAKP

SEQ ID NO: 110 - protein, 46 aa, ARTIFICIAL SEQUENCE
  Engineered albumin binding polypeptide
LAEAKVLANRELDKYGKSDFYKNLINRAKTVEGVNSLTSHILAACP

SEQ ID NO: 111 - protein, 46 aa, ARTIFICIAL SEQUENCE
  Engineered albumin binding polypeptide
LAEAKVLANRELDKYGCSDFYKNLINRAKTVEGVNSLTSHILAACP

SEQ ID NO: 112 - protein, 46 aa, ARTIFICIAL SEQUENCE
  Engineered albumin binding polypeptide
LAEAKVLANRELDKYGKSDFYKNLINRAKTVEGVNSLTSHILAAKP

SEQ ID NO: 113 - protein, 46 aa, ARTIFICIAL SEQUENCE
  Engineered albumin binding polypeptide
LAEAKVLANRELDKYGCSDFYKNLINRAKTVEGVNTLIHDILAAKP

SEQ ID NO: 114 - protein, 46 aa, ARTIFICIAL SEQUENCE
  Engineered albumin binding polypeptide
LAEAKVLANRELDKYGKSDFYKNLINRAKTVEGVNTLIHDILAACP

SEQ ID NO: 115 - protein, 46 aa, ARTIFICIAL SEQUENCE
  Engineered albumin binding polypeptide
LAEAKVLANRELDKYGCSDFYKNLINRAKTVEGVNTLIHDILAACP

SEQ ID NO: 116 - protein, 46 aa, ARTIFICIAL SEQUENCE
  Engineered albumin binding polypeptide
LAEAKVLANRELDKYGKSDFYKNLINRAKTVEGVNTLIHDILAAKP

SEQ ID NO: 117 - protein, 46 aa, ARTIFICIAL SEQUENCE
  Engineered albumin binding polypeptide
LAEAKVLANRELDKYGCSDFYKNLINRAKTVEGVESLIGEILAAKP

SEQ ID NO: 118 - protein, 46 aa, ARTIFICIAL SEQUENCE
  Engineered albumin binding polypeptide
LAEAKVLANRELDKYGKSDFYKNLINRAKTVEGVESLIGEILAACP

SEQ ID NO: 119 - protein, 46 aa, ARTIFICIAL SEQUENCE
  Engineered albumin binding polypeptide
LAEAKVLANRELDKYGCSDFYKNLINRAKTVEGVESLIGEILAACP

SEQ ID NO: 120 - protein, 46 aa, ARTIFICIAL SEQUENCE
  Engineered albumin binding polypeptide
LAEAKVLANRELDKYGKSDFYKNLINRAKTVEGVESLIGEILAAKP

SEQ ID NO: 121 - protein, 46 aa, ARTIFICIAL SEQUENCE
  Engineered albumin binding polypeptide
LAEAKVLANRELDKYGCSDFYKNLINKAKTVEGVHTLIHDILAAKP

SEQ ID NO: 122 - protein, 46 aa, ARTIFICIAL SEQUENCE
  Engineered albumin binding polypeptide
LAEAKVLANRELDKYGKSDFYKNLINKAKTVEGVHTLIHDILAACP

SEQ ID NO: 123 - protein, 46 aa, ARTIFICIAL SEQUENCE
  Engineered albumin binding polypeptide
LAEAKVLANRELDKYGCSDFYKNLINKAKTVEGVHTLIHDILAACP

SEQ ID NO: 124 - protein, 46 aa, ARTIFICIAL SEQUENCE
  Engineered albumin binding polypeptide
LAEAKVLANRELDKYGKSDFYKNLINKAKTVEGVHTLIHDILAAKP

SEQ ID NO: 125 - protein, 46 aa, ARTIFICIAL SEQUENCE
  Engineered albumin binding polypeptide
LAEAKVLANRELDKYGCSDYYKNLINKAKTVEGVSALKMHILAAKP

SEQ ID NO: 126 - protein, 46 aa, ARTIFICIAL SEQUENCE
  Engineered albumin binding polypeptide
LAEAKVLANRELDKYGKSDYYKNLINKAKTVEGVSALKMHILAACP

SEQ ID NO: 127 - protein, 46 aa, ARTIFICIAL SEQUENCE
  Engineered albumin binding polypeptide
LAEAKVLANRELDKYGCSDYYKNLINKAKTVEGVSALKMHILAACP

SEQ ID NO: 128 - protein, 46 aa, ARTIFICIAL SEQUENCE
  Engineered albumin binding polypeptide
LAEAKVLANRELDKYGKSDYYKNLINKAKTVEGVSALKMHILAAKP

SEQ ID NO: 129 - protein, 46 aa, ARTIFICIAL SEQUENCE
  Engineered albumin binding polypeptide
LAEAKVLANRELDKYGCSDFYKNLINKAKTVEGVDALIVHILAAKP

SEQ ID NO: 130 - protein, 46 aa, ARTIFICIAL SEQUENCE
  Engineered albumin binding polypeptide
LAEAKVLANRELDKYGKSDFYKNLINKAKTVEGVDALIVHILAACP

SEQ ID NO: 131 - protein, 46 aa, ARTIFICIAL SEQUENCE
  Engineered albumin binding polypeptide
LAEAKVLANRELDKYGCSDFYKNLINKAKTVEGVDALIVHILAACP

SEQ ID NO: 132 - protein, 46 aa, ARTIFICIAL SEQUENCE
  Engineered albumin binding polypeptide
LAEAKVLANRELDKYGKSDFYKNLINKAKTVEGVDALIVHILAAKP

SEQ ID NO: 133 - protein, 46 aa, ARTIFICIAL SEQUENCE
  Engineered albumin binding polypeptide
LAEAKVLANRELDKYGCSDYYKRLINRAKTVEGVHALIAEILAAKP

SEQ ID NO: 134 - protein, 46 aa, ARTIFICIAL SEQUENCE
  Engineered albumin binding polypeptide
LAEAKVLANRELDKYGKSDYYKRLINRAKTVEGVHALIAEILAACP

SEQ ID NO: 135 - protein, 46 aa, ARTIFICIAL SEQUENCE
  Engineered albumin binding polypeptide
LAEAKVLANRELDKYGCSDYYKRLINRAKTVEGVHALIAEILAACP

SEQ ID NO: 136 - protein, 46 aa, ARTIFICIAL SEQUENCE
  Engineered albumin binding polypeptide
LAEAKVLANRELDKYGKSDYYKRLINRAKTVEGVHALIAEILAAKP

SEQ ID NO: 137 - protein, 46 aa, ARTIFICIAL SEQUENCE
  Engineered albumin binding polypeptide
LAEAKVLANRELDKYGCSDYYKNLINRARTVEGVDTLIHDILAAKP

SEQ ID NO: 138 - protein, 46 aa, ARTIFICIAL SEQUENCE
  Engineered albumin binding polypeptide
LAEAKVLANRELDKYGKSDYYKNLINRARTVEGVDTLIHDILAACP

SEQ ID NO: 139 - protein, 46 aa, ARTIFICIAL SEQUENCE
  Engineered albumin binding polypeptide
LAEAKVLANRELDKYGCSDYYKNLINRARTVEGVDTLIHDILAACP

SEQ ID NO: 140 - protein, 46 aa, ARTIFICIAL SEQUENCE
  Engineered albumin binding polypeptide
LAEAKVLANRELDKYGKSDYYKNLINRARTVEGVDTLIHDILAAKP

SEQ ID NO: 141 - protein, 46 aa, ARTIFICIAL SEQUENCE
  Engineered albumin binding polypeptide
LAEAKVLANRELDKYGCSDFYKKVINRARTVEGVQALIADILAAKP

SEQ ID NO: 142 - protein, 46 aa, ARTIFICIAL SEQUENCE
  Engineered albumin binding polypeptide
LAEAKVLANRELDKYGKSDFYKKVINRARTVEGVQALIADILAACP

SEQ ID NO: 143 - protein, 46 aa, ARTIFICIAL SEQUENCE
  Engineered albumin binding polypeptide
LAEAKVLANRELDKYGCSDFYKKVINRARTVEGVQALIADILAACP

SEQ ID NO: 144 - protein, 46 aa, ARTIFICIAL SEQUENCE
  Engineered albumin binding polypeptide
LAEAKVLANRELDKYGKSDFYKKVINRARTVEGVQALIADILAAKP

SEQ ID NO: 145 - protein, 46 aa, ARTIFICIAL SEQUENCE
  Engineered albumin binding polypeptide
LAEAKVLANRELDKYGCSDFYKNLINRAKTVEGVESLIADILAAKP

SEQ ID NO: 146 - protein, 46 aa, ARTIFICIAL SEQUENCE
  Engineered albumin binding polypeptide
LAEAKVLANRELDKYGKSDFYKNLINRAKTVEGVESLIADILAACP

SEQ ID NO: 147 - protein, 46 aa, ARTIFICIAL SEQUENCE
  Engineered albumin binding polypeptide
LAEAKVLANRELDKYGCSDFYKNLINRAKTVEGVESLIADILAACP

SEQ ID NO: 148 - protein, 46 aa, ARTIFICIAL SEQUENCE
  Engineered albumin binding polypeptide
LAEAKVLANRELDKYGKSDFYKNLINRAKTVEGVESLIADILAAKP

SEQ ID NO: 149 - protein, 46 aa, ARTIFICIAL SEQUENCE
  Engineered albumin binding polypeptide
LAEAKVLANRELDKYGCSDYYKNLINKAKTVEGVDALIAHILAAKP

SEQ ID NO: 150 - protein, 46 aa, ARTIFICIAL SEQUENCE
  Engineered albumin binding polypeptide
LAEAKVLANRELDKYGKSDYYKNLINKAKTVEGVDALIAHILAACP

SEQ ID NO: 151 - protein, 46 aa, ARTIFICIAL SEQUENCE
  Engineered albumin binding polypeptide
LAEAKVLANRELDKYGCSDYYKNLINKAKTVEGVDALIAHILAACP

SEQ ID NO: 152 - protein, 46 aa, ARTIFICIAL SEQUENCE
  Engineered albumin binding polypeptide
LAEAKVLANRELDKYGKSDYYKNLINKAKTVEGVDALIAHILAAKP

SEQ ID NO: 153 - protein, 46 aa, ARTIFICIAL SEQUENCE
  Engineered albumin binding polypeptide
LAEAKVLANRELDKYGCSDYYKNLINRAKTVEGVESLITHILAAKP

SEQ ID NO: 154 - protein, 46 aa, ARTIFICIAL SEQUENCE
  Engineered albumin binding polypeptide
LAEAKVLANRELDKYGKSDYYKNLINRAKTVEGVESLITHILAACP

SEQ ID NO: 155 - protein, 46 aa, ARTIFICIAL SEQUENCE
  Engineered albumin binding polypeptide
LAEAKVLANRELDKYGCSDYYKNLINRAKTVEGVESLITHILAACP

SEQ ID NO: 156 - protein, 46 aa, ARTIFICIAL SEQUENCE
  Engineered albumin binding polypeptide
LAEAKVLANRELDKYGKSDYYKNLINRAKTVEGVESLITHILAAKP

SEQ ID NO: 157 - protein, 46 aa, ARTIFICIAL SEQUENCE
  Engineered albumin binding polypeptide
LAEAKVLANRELDKYGCSDFYKNLINRARTVEGVDSLIVEILAAKP

SEQ ID NO: 158 - protein, 46 aa, ARTIFICIAL SEQUENCE
  Engineered albumin binding polypeptide
LAEAKVLANRELDKYGKSDFYKNLINRARTVEGVDSLIVEILAACP

SEQ ID NO: 159 - protein, 46 aa, ARTIFICIAL SEQUENCE
  Engineered albumin binding polypeptide
LAEAKVLANRELDKYGCSDFYKNLINRARTVEGVDSLIVEILAACP

SEQ ID NO: 160 - protein, 46 aa, ARTIFICIAL SEQUENCE
  Engineered albumin binding polypeptide
LAEAKVLANRELDKYGKSDFYKNLINRARTVEGVDSLIVEILAAKP

SEQ ID NO: 161 - protein, 46 aa, ARTIFICIAL SEQUENCE
  Engineered albumin binding polypeptide
LAEAKVLANRELDKYGCSDFYKNVINRAKTVEGVSALIREILAAKP

SEQ ID NO: 162 - protein, 46 aa, ARTIFICIAL SEQUENCE
  Engineered albumin binding polypeptide
LAEAKVLANRELDKYGKSDFYKNVINRAKTVEGVSALIREILAACP

SEQ ID NO: 163 - protein, 46 aa, ARTIFICIAL SEQUENCE
  Engineered albumin binding polypeptide
LAEAKVLANRELDKYGCSDFYKNVINRAKTVEGVSALIREILAACP

SEQ ID NO: 164 - protein, 46 aa, ARTIFICIAL SEQUENCE
  Engineered albumin binding polypeptide
LAEAKVLANRELDKYGKSDFYKNVINRAKTVEGVSALIREILAAKP

SEQ ID NO: 165 - protein, 46 aa, ARTIFICIAL SEQUENCE
  Engineered albumin binding polypeptide
LAEAKVLANRELDKYGCSDFYKNLINRAKTVEGVNALISDILAAKP

SEQ ID NO: 166 - protein, 46 aa, ARTIFICIAL SEQUENCE
  Engineered albumin binding polypeptide
LAEAKVLANRELDKYGKSDFYKNLINRAKTVEGVNALISDILAACP

SEQ ID NO: 167 - protein, 46 aa, ARTIFICIAL SEQUENCE
  Engineered albumin binding polypeptide
LAEAKVLANRELDKYGCSDFYKNLINRAKTVEGVNALISDILAACP

SEQ ID NO: 168 - protein, 46 aa, ARTIFICIAL SEQUENCE
  Engineered albumin binding polypeptide
LAEAKVLANRELDKYGKSDFYKNLINRAKTVEGVNALISDILAAKP

SEQ ID NO: 169 - protein, 46 aa, ARTIFICIAL SEQUENCE
  Engineered albumin binding polypeptide
LAEAKVLANRELDKYGCSDFYKNLINRAKTVEGVSALIQEILAAKP

SEQ ID NO: 170 - protein, 46 aa, ARTIFICIAL SEQUENCE
  Engineered albumin binding polypeptide
LAEAKVLANRELDKYGKSDFYKNLINRAKTVEGVSALIQEILAACP

SEQ ID NO: 171 - protein, 46 aa, ARTIFICIAL SEQUENCE
  Engineered albumin binding polypeptide
LAEAKVLANRELDKYGCSDFYKNLINRAKTVEGVSALIQEILAACP

SEQ ID NO: 172 - protein, 46 aa, ARTIFICIAL SEQUENCE
  Engineered albumin binding polypeptide
LAEAKVLANRELDKYGKSDFYKNLINRAKTVEGVSALIQEILAAKP

SEQ ID NO: 173 - protein, 46 aa, ARTIFICIAL SEQUENCE
  Engineered albumin binding polypeptide
LAEAKVLANRELDKYGCSDFYKNLINRAKTVEGVQSLIDHILAAKP

SEQ ID NO: 174 - protein, 46 aa, ARTIFICIAL SEQUENCE
  Engineered albumin binding polypeptide
LAEAKVLANRELDKYGKSDFYKNLINRAKTVEGVQSLIDHILAACP

SEQ ID NO: 175 - protein, 46 aa, ARTIFICIAL SEQUENCE
  Engineered albumin binding polypeptide
LAEAKVLANRELDKYGCSDFYKNLINRAKTVEGVQSLIDHILAACP

SEQ ID NO: 176 - protein, 46 aa, ARTIFICIAL SEQUENCE
  Engineered albumin binding polypeptide
LAEAKVLANRELDKYGKSDFYKNLINRAKTVEGVQSLIDHILAAKP

SEQ ID NO: 177 - protein, 46 aa, ARTIFICIAL SEQUENCE
  Engineered albumin binding polypeptide
LAEAKVLANRELDKYGCSDFYKNLINRAKTVEGVDALICHILAAKP

SEQ ID NO: 178 - protein, 46 aa, ARTIFICIAL SEQUENCE
  Engineered albumin binding polypeptide
LAEAKVLANRELDKYGKSDFYKNLINRAKTVEGVDALICHILAACP

SEQ ID NO: 179 - protein, 46 aa, ARTIFICIAL SEQUENCE
  Engineered albumin binding polypeptide
LAEAKVLANRELDKYGCSDFYKNLINRAKTVEGVDALICHILAACP

SEQ ID NO: 180 - protein, 46 aa, ARTIFICIAL SEQUENCE
  Engineered albumin binding polypeptide
LAEAKVLANRELDKYGKSDFYKNLINRAKTVEGVDALICHILAAKP

SEQ ID NO: 181 - protein, 46 aa, ARTIFICIAL SEQUENCE
  Engineered albumin binding polypeptide
LAEAKVLANRELDKYGCSDYYKRLINKAKTVEGVNALITHILAAKP

SEQ ID NO: 182 - protein, 46 aa, ARTIFICIAL SEQUENCE
  Engineered albumin binding polypeptide
LAEAKVLANRELDKYGKSDYYKRLINKAKTVEGVNALITHILAACP

SEQ ID NO: 183 - protein, 46 aa, ARTIFICIAL SEQUENCE
  Engineered albumin binding polypeptide
LAEAKVLANRELDKYGCSDYYKRLINKAKTVEGVNALITHILAACP

SEQ ID NO: 184 - protein, 46 aa, ARTIFICIAL SEQUENCE
  Engineered albumin binding polypeptide
LAEAKVLANRELDKYGKSDYYKRLINKAKTVEGVNALITHILAAKP

SEQ ID NO: 185 - protein, 46 aa, ARTIFICIAL SEQUENCE
  Engineered albumin binding polypeptide
LAEAKVLANRELDKYGCSDFYKNVINKAKTVEGVEALIADILAAKP

SEQ ID NO: 186 - protein, 46 aa, ARTIFICIAL SEQUENCE
  Engineered albumin binding polypeptide
LAEAKVLANRELDKYGKSDFYKNVINKAKTVEGVEALIADILAACP

SEQ ID NO: 187 - protein, 46 aa, ARTIFICIAL SEQUENCE
  Engineered albumin binding polypeptide
LAEAKVLANRELDKYGCSDFYKNVINKAKTVEGVEALIADILAACP

SEQ ID NO: 188 - protein, 46 aa, ARTIFICIAL SEQUENCE
  Engineered albumin binding polypeptide
LAEAKVLANRELDKYGKSDFYKNVINKAKTVEGVEALIADILAAKP

SEQ ID NO: 189 - protein, 46 aa, ARTIFICIAL SEQUENCE
  Engineered albumin binding polypeptide
LAEAKVLANRELDKYGCSDFYKNLINRAKTVEGVETLIRDILAAKP

SEQ ID NO: 190 - protein, 46 aa, ARTIFICIAL SEQUENCE
  Engineered albumin binding polypeptide
LAEAKVLANRELDKYGKSDFYKNLINRAKTVEGVETLIRDILAACP

SEQ ID NO: 191 - protein, 46 aa, ARTIFICIAL SEQUENCE
  Engineered albumin binding polypeptide
LAEAKVLANRELDKYGCSDFYKNLINRAKTVEGVETLIRDILAACP

SEQ ID NO: 192 - protein, 46 aa, ARTIFICIAL SEQUENCE
  Engineered albumin binding polypeptide
LAEAKVLANRELDKYGKSDFYKNLINRAKTVEGVETLIRDILAAKP

SEQ ID NO: 193 - protein, 46 aa, ARTIFICIAL SEQUENCE
  Engineered albumin binding polypeptide
LAEAKVLANRELDKYGCSDFYKNLINRARTVEGVQTLITDILAAKP

SEQ ID NO: 194 - protein, 46 aa, ARTIFICIAL SEQUENCE
  Engineered albumin binding polypeptide
LAEAKVLANRELDKYGKSDFYKNLINRARTVEGVQTLITDILAACP

SEQ ID NO: 195 - protein, 46 aa, ARTIFICIAL SEQUENCE
  Engineered albumin binding polypeptide
LAEAKVLANRELDKYGCSDFYKNLINRARTVEGVQTLITDILAACP

SEQ ID NO: 196 - protein, 46 aa, ARTIFICIAL SEQUENCE
  Engineered albumin binding polypeptide
LAEAKVLANRELDKYGKSDFYKNLINRARTVEGVQTLITDILAAKP

SEQ ID NO: 197 - protein, 46 aa, ARTIFICIAL SEQUENCE
  Engineered albumin binding polypeptide
LAEAKVLANRELDKYGCSDFYKRLINKAKTVEGVNALTHHILAAKP

SEQ ID NO: 198 - protein, 46 aa, ARTIFICIAL SEQUENCE
  Engineered albumin binding polypeptide
LAEAKVLANRELDKYGKSDFYKRLINKAKTVEGVNALTHHILAACP

SEQ ID NO: 199 - protein, 46 aa, ARTIFICIAL SEQUENCE
  Engineered albumin binding polypeptide
LAEAKVLANRELDKYGCSDFYKRLINKAKTVEGVNALTHHILAACP

SEQ ID NO: 200 - protein, 46 aa, ARTIFICIAL SEQUENCE
  Engineered albumin binding polypeptide
LAEAKVLANRELDKYGKSDFYKRLINKAKTVEGVNALTHHILAAKP

SEQ ID NO: 201 - protein, 46 aa, ARTIFICIAL SEQUENCE
  Engineered albumin binding polypeptide
LAEAKVLANRELDKYGCSDYYKNLINRAKTVEGVQALIAHILAAKP

SEQ ID NO: 202 - protein, 46 aa, ARTIFICIAL SEQUENCE
  Engineered albumin binding polypeptide
LAEAKVLANRELDKYGKSDYYKNLINRAKTVEGVQALIAHILAACP

SEQ ID NO: 203 - protein, 46 aa, ARTIFICIAL SEQUENCE
  Engineered albumin binding polypeptide
LAEAKVLANRELDKYGCSDYYKNLINRAKTVEGVQALIAHILAACP

SEQ ID NO: 204 - protein, 46 aa, ARTIFICIAL SEQUENCE
  Engineered albumin binding polypeptide
LAEAKVLANRELDKYGKSDYYKNLINRAKTVEGVQALIAHILAAKP

SEQ ID NO: 205 - protein, 46 aa, ARTIFICIAL SEQUENCE
  Engineered albumin binding polypeptide
LAEAKVLANRELDKYGCSDFYKNVINRAKTVEGVNSLINHILAAKP

SEQ ID NO: 206 - protein, 46 aa, ARTIFICIAL SEQUENCE
  Engineered albumin binding polypeptide
LAEAKVLANRELDKYGKSDFYKNVINRAKTVEGVNSLINHILAACP

SEQ ID NO: 207 - protein, 46 aa, ARTIFICIAL SEQUENCE
  Engineered albumin binding polypeptide
LAEAKVLANRELDKYGCSDFYKNVINRAKTVEGVNSLINHILAACP

SEQ ID NO: 208 - protein, 46 aa, ARTIFICIAL SEQUENCE
  Engineered albumin binding polypeptide
LAEAKVLANRELDKYGKSDFYKNVINRAKTVEGVNSLINHILAAKP

SEQ ID NO: 209 - protein, 46 aa, ARTIFICIAL SEQUENCE
  Engineered albumin binding polypeptide
LAEAKVLANRELDKYGCSDFYKSLINRARTVEGVDSLIRHILAAKP

SEQ ID NO: 210 - protein, 46 aa, ARTIFICIAL SEQUENCE
  Engineered albumin binding polypeptide
LAEAKVLANRELDKYGKSDFYKSLINRARTVEGVDSLIRHILAACP

SEQ ID NO: 211 - protein, 46 aa, ARTIFICIAL SEQUENCE
  Engineered albumin binding polypeptide
LAEAKVLANRELDKYGCSDFYKSLINRARTVEGVDSLIRHILAACP

SEQ ID NO: 212 - protein, 46 aa, ARTIFICIAL SEQUENCE
  Engineered albumin binding polypeptide
LAEAKVLANRELDKYGKSDFYKSLINRARTVEGVDSLIRHILAAKP

SEQ ID NO: 213 - protein, 46 aa, ARTIFICIAL SEQUENCE
  Engineered albumin binding polypeptide
LAEAKVLANRELDKYGCSDYYKNLINKAKTVEGVEALTLHILAAKP

SEQ ID NO: 214 - protein, 46 aa, ARTIFICIAL SEQUENCE
  Engineered albumin binding polypeptide
LAEAKVLANRELDKYGKSDYYKNLINKAKTVEGVEALTLHILAACP

SEQ ID NO: 215 - protein, 46 aa, ARTIFICIAL SEQUENCE
  Engineered albumin binding polypeptide
LAEAKVLANRELDKYGCSDYYKNLINKAKTVEGVEALTLHILAACP

SEQ ID NO: 216 - protein, 46 aa, ARTIFICIAL SEQUENCE
  Engineered albumin binding polypeptide
LAEAKVLANRELDKYGKSDYYKNLINKAKTVEGVEALTLHILAAKP

SEQ ID NO: 217 - protein, 46 aa, ARTIFICIAL SEQUENCE
  Engineered albumin binding polypeptide
LAEAKVLANRELDKYGCSDFYKNLINRAKTVEGVDALIAHILAAKP

SEQ ID NO: 218 - protein, 46 aa, ARTIFICIAL SEQUENCE
  Engineered albumin binding polypeptide
LAEAKVLANRELDKYGKSDFYKNLINRAKTVEGVDALIAHILAACP

SEQ ID NO: 219 - protein, 46 aa, ARTIFICIAL SEQUENCE
  Engineered albumin binding polypeptide
LAEAKVLANRELDKYGCSDFYKNLINRAKTVEGVDALIAHILAACP

SEQ ID NO: 220 - protein, 46 aa, ARTIFICIAL SEQUENCE
  Engineered albumin binding polypeptide
LAEAKVLANRELDKYGKSDFYKNLINRAKTVEGVDALIAHILAAKP

SEQ ID NO: 221 - protein, 46 aa, ARTIFICIAL SEQUENCE
  Engineered albumin binding polypeptide
LAEAKVLANRELDKYGCSDYYKNLINKAKTVEGVQALIAHILAAKP

SEQ ID NO: 222 - protein, 46 aa, ARTIFICIAL SEQUENCE
  Engineered albumin binding polypeptide
LAEAKVLANRELDKYGKSDYYKNLINKAKTVEGVQALIAHILAACP

SEQ ID NO: 223 - protein, 46 aa, ARTIFICIAL SEQUENCE
  Engineered albumin binding polypeptide
LAEAKVLANRELDKYGCSDYYKNLINKAKTVEGVQALIAHILAACP

SEQ ID NO: 224 - protein, 46 aa, ARTIFICIAL SEQUENCE
  Engineered albumin binding polypeptide
LAEAKVLANRELDKYGKSDYYKNLINKAKTVEGVQALIAHILAAKP

SEQ ID NO: 225 - protein, 46 aa, ARTIFICIAL SEQUENCE
  Engineered albumin binding polypeptide
LAEAKVLANRELDKYGCSDFYKRLINRAKTVEGVHALIGHILAAKP

SEQ ID NO: 226 - protein, 46 aa, ARTIFICIAL SEQUENCE
  Engineered albumin binding polypeptide
LAEAKVLANRELDKYGKSDFYKRLINRAKTVEGVHALIGHILAACP

SEQ ID NO: 227 - protein, 46 aa, ARTIFICIAL SEQUENCE
  Engineered albumin binding polypeptide
LAEAKVLANRELDKYGCSDFYKRLINRAKTVEGVHALIGHILAACP

SEQ ID NO: 228 - protein, 46 aa, ARTIFICIAL SEQUENCE
  Engineered albumin binding polypeptide
LAEAKVLANRELDKYGKSDFYKRLINRAKTVEGVHALIGHILAAKP

SEQ ID NO: 229 - protein, 46 aa, ARTIFICIAL SEQUENCE
  Engineered albumin binding polypeptide
LAEAKVLANRELDKYGCSDFYKRVINRAKTVEGVHALIDHILAAKP

SEQ ID NO: 230 - protein, 46 aa, ARTIFICIAL SEQUENCE
  Engineered albumin binding polypeptide
LAEAKVLANRELDKYGKSDFYKRVINRAKTVEGVHALIDHILAACP

SEQ ID NO: 231 - protein, 46 aa, ARTIFICIAL SEQUENCE
  Engineered albumin binding polypeptide
LAEAKVLANRELDKYGCSDFYKRVINRAKTVEGVHALIDHILAACP

SEQ ID NO: 232 - protein, 46 aa, ARTIFICIAL SEQUENCE
  Engineered albumin binding polypeptide
LAEAKVLANRELDKYGKSDFYKRVINRAKTVEGVHALIDHILAAKP

SEQ ID NO: 233 - protein, 46 aa, ARTIFICIAL SEQUENCE
  Engineered albumin binding polypeptide
LAEAKVLANRELDKYGCSDYYKRIINRAKTVEGVRALKLHILAAKP

SEQ ID NO: 234 - protein, 46 aa, ARTIFICIAL SEQUENCE
  Engineered albumin binding polypeptide
LAEAKVLANRELDKYGKSDYYKRIINRAKTVEGVRALKLHILAACP

SEQ ID NO: 235 - protein, 46 aa, ARTIFICIAL SEQUENCE
  Engineered albumin binding polypeptide
LAEAKVLANRELDKYGCSDYYKRIINRAKTVEGVRALKLHILAACP

SEQ ID NO: 236 - protein, 46 aa, ARTIFICIAL SEQUENCE
  Engineered albumin binding polypeptide
LAEAKVLANRELDKYGKSDYYKRIINRAKTVEGVRALKLHILAAKP

SEQ ID NO: 237 - protein, 46 aa, ARTIFICIAL SEQUENCE
  Engineered albumin binding polypeptide
LAEAKVLANRELDKYGCSDFYKRVINRAKTVEGVSALIHEILAAKP

SEQ ID NO: 238 - protein, 46 aa, ARTIFICIAL SEQUENCE
  Engineered albumin binding polypeptide
LAEAKVLANRELDKYGKSDFYKRVINRAKTVEGVSALIHEILAACP

SEQ ID NO: 239 - protein, 46 aa, ARTIFICIAL SEQUENCE
  Engineered albumin binding polypeptide
LAEAKVLANRELDKYGCSDFYKRVINRAKTVEGVSALIHEILAACP

SEQ ID NO: 240 - protein, 46 aa, ARTIFICIAL SEQUENCE
  Engineered albumin binding polypeptide
LAEAKVLANRELDKYGKSDFYKRVINRAKTVEGVSALIHEILAAKP

SEQ ID NO: 241 - protein, 46 aa, ARTIFICIAL SEQUENCE
  Engineered albumin binding polypeptide
LAEAKVLANRELDKYGCSDYYKRLINRAKTVEGVNSLISHILAAKP

SEQ ID NO: 242 - protein, 46 aa, ARTIFICIAL SEQUENCE
  Engineered albumin binding polypeptide
LAEAKVLANRELDKYGKSDYYKRLINRAKTVEGVNSLISHILAACP

SEQ ID NO: 243 - protein, 46 aa, ARTIFICIAL SEQUENCE
  Engineered albumin binding polypeptide
LAEAKVLANRELDKYGCSDYYKRLINRAKTVEGVNSLISHILAACP

SEQ ID NO: 244 - protein, 46 aa, ARTIFICIAL SEQUENCE
  Engineered albumin binding polypeptide
LAEAKVLANRELDKYGKSDYYKRLINRAKTVEGVNSLISHILAAKP

SEQ ID NO: 245 - protein, 46 aa, ARTIFICIAL SEQUENCE
  Engineered albumin binding polypeptide
LAEAKVLANRELDKYGCSDFYKRLINRAKTVEGVSSLKGHILAAKP

SEQ ID NO: 246 - protein, 46 aa, ARTIFICIAL SEQUENCE
  Engineered albumin binding polypeptide
LAEAKVLANRELDKYGKSDFYKRLINRAKTVEGVSSLKGHILAACP

SEQ ID NO: 247 - protein, 46 aa, ARTIFICIAL SEQUENCE
  Engineered albumin binding polypeptide
LAEAKVLANRELDKYGCSDFYKRLINRAKTVEGVSSLKGHILAACP

SEQ ID NO: 248 - protein, 46 aa, ARTIFICIAL SEQUENCE
  Engineered albumin binding polypeptide
LAEAKVLANRELDKYGKSDFYKRLINRAKTVEGVSSLKGHILAAKP

SEQ ID NO: 249 - protein, 46 aa, ARTIFICIAL SEQUENCE
  Engineered albumin binding polypeptide
LAEAKVLANRELDKYGCSDFYKRVINRAKTVEGVDSLIAEILAAKP

SEQ ID NO: 250 - protein, 46 aa, ARTIFICIAL SEQUENCE
  Engineered albumin binding polypeptide
LAEAKVLANRELDKYGKSDFYKRVINRAKTVEGVDSLIAEILAACP

SEQ ID NO: 251 - protein, 46 aa, ARTIFICIAL SEQUENCE
  Engineered albumin binding polypeptide
LAEAKVLANRELDKYGCSDFYKRVINRAKTVEGVDSLIAEILAACP

SEQ ID NO: 252 - protein, 46 aa, ARTIFICIAL SEQUENCE
  Engineered albumin binding polypeptide
LAEAKVLANRELDKYGKSDFYKRVINRAKTVEGVDSLIAEILAAKP

SEQ ID NO: 253 - protein, 46 aa, ARTIFICIAL SEQUENCE
  Engineered albumin binding polypeptide
LAEAKVLANRELDKYGCSDFYKRLINRARTVEGVQTLISDILAAKP

SEQ ID NO: 254 - protein, 46 aa, ARTIFICIAL SEQUENCE
  Engineered albumin binding polypeptide
LAEAKVLANRELDKYGKSDFYKRLINRARTVEGVQTLISDILAACP

SEQ ID NO: 255 - protein, 46 aa, ARTIFICIAL SEQUENCE
  Engineered albumin binding polypeptide
LAEAKVLANRELDKYGCSDFYKRLINRARTVEGVQTLISDILAACP

SEQ ID NO: 256 - protein, 46 aa, ARTIFICIAL SEQUENCE
  Engineered albumin binding polypeptide
LAEAKVLANRELDKYGKSDFYKRLINRARTVEGVQTLISDILAAKP

SEQ ID NO: 257 - protein, 46 aa, ARTIFICIAL SEQUENCE
  Engineered albumin binding polypeptide
LAEAKVLANRELDKYGCSDFYKRFINKAKTVEGVETLISEILAAKP

SEQ ID NO: 258 - protein, 46 aa, ARTIFICIAL SEQUENCE
  Engineered albumin binding polypeptide
LAEAKVLANRELDKYGKSDFYKRFINKAKTVEGVETLISEILAACP

SEQ ID NO: 259 - protein, 46 aa, ARTIFICIAL SEQUENCE
  Engineered albumin binding polypeptide
LAEAKVLANRELDKYGCSDFYKRFINKAKTVEGVETLISEILAACP

SEQ ID NO: 260 - protein, 46 aa, ARTIFICIAL SEQUENCE
  Engineered albumin binding polypeptide
LAEAKVLANRELDKYGKSDFYKRFINKAKTVEGVETLISEILAAKP

SEQ ID NO: 261 - protein, 46 aa, ARTIFICIAL SEQUENCE
  Engineered albumin binding polypeptide
LAEAKVLANRELDKYGCSDFYKRLINRAKTVEGVHSLTDEILAAKP

SEQ ID NO: 262 - protein, 46 aa, ARTIFICIAL SEQUENCE
  Engineered albumin binding polypeptide
LAEAKVLANRELDKYGKSDFYKRLINRAKTVEGVHSLTDEILAACP

SEQ ID NO: 263 - protein, 46 aa, ARTIFICIAL SEQUENCE
  Engineered albumin binding polypeptide
LAEAKVLANRELDKYGCSDFYKRLINRAKTVEGVHSLTDEILAACP

SEQ ID NO: 264 - protein, 46 aa, ARTIFICIAL SEQUENCE
  Engineered albumin binding polypeptide
LAEAKVLANRELDKYGKSDFYKRLINRAKTVEGVHSLTDEILAAKP

SEQ ID NO: 265 - protein, 46 aa, ARTIFICIAL SEQUENCE
  Engineered albumin binding polypeptide
LAEAKVLANRELDKYGCSDYYKRVINKAKTVEGVSSLTAEILAAKP

SEQ ID NO: 266 - protein, 46 aa, ARTIFICIAL SEQUENCE
  Engineered albumin binding polypeptide
LAEAKVLANRELDKYGKSDYYKRVINKAKTVEGVSSLTAEILAACP

SEQ ID NO: 267 - protein, 46 aa, ARTIFICIAL SEQUENCE
  Engineered albumin binding polypeptide
LAEAKVLANRELDKYGCSDYYKRVINKAKTVEGVSSLTAEILAACP

SEQ ID NO: 268 - protein, 46 aa, ARTIFICIAL SEQUENCE
  Engineered albumin binding polypeptide
LAEAKVLANRELDKYGKSDYYKRVINKAKTVEGVSSLTAEILAAKP

SEQ ID NO: 269 - protein, 46 aa, ARTIFICIAL SEQUENCE
  Engineered albumin binding polypeptide
LAEAKVLANRELDKYGCSDFYKRLINRAKTVEGVDALTSHILAAKP

SEQ ID NO: 270 - protein, 46 aa, ARTIFICIAL SEQUENCE
  Engineered albumin binding polypeptide
LAEAKVLANRELDKYGKSDFYKRLINRAKTVEGVDALTSHILAACP

SEQ ID NO: 271 - protein, 46 aa, ARTIFICIAL SEQUENCE
  Engineered albumin binding polypeptide
LAEAKVLANRELDKYGCSDFYKRLINRAKTVEGVDALTSHILAACP

SEQ ID NO: 272 - protein, 46 aa, ARTIFICIAL SEQUENCE
  Engineered albumin binding polypeptide
LAEAKVLANRELDKYGKSDFYKRLINRAKTVEGVDALTSHILAAKP

SEQ ID NO: 273 - protein, 46 aa, ARTIFICIAL SEQUENCE
  Engineered albumin binding polypeptide
LAEAKVLANRELDKYGCSDFYKRLINKAKTVEGVSTLIHDILAAKP

SEQ ID NO: 274 - protein, 46 aa, ARTIFICIAL SEQUENCE
  Engineered albumin binding polypeptide
LAEAKVLANRELDKYGKSDFYKRLINKAKTVEGVSTLIHDILAACP

SEQ ID NO: 275 - protein, 46 aa, ARTIFICIAL SEQUENCE
  Engineered albumin binding polypeptide
LAEAKVLANRELDKYGCSDFYKRLINKAKTVEGVSTLIHDILAACP

SEQ ID NO: 276 - protein, 46 aa, ARTIFICIAL SEQUENCE
  Engineered albumin binding polypeptide
LAEAKVLANRELDKYGKSDFYKRLINKAKTVEGVSTLIHDILAAKP

SEQ ID NO: 277 - protein, 46 aa, ARTIFICIAL SEQUENCE
  Engineered albumin binding polypeptide
LAEAKVLANRELDKYGCSDFYKRLINRAKTVEGVSTLIHDILAAKP

SEQ ID NO: 278 - protein, 46 aa, ARTIFICIAL SEQUENCE
  Engineered albumin binding polypeptide
LAEAKVLANRELDKYGKSDFYKRLINRAKTVEGVSTLIHDILAACP

SEQ ID NO: 279 - protein, 46 aa, ARTIFICIAL SEQUENCE
  Engineered albumin binding polypeptide
LAEAKVLANRELDKYGCSDFYKRLINRAKTVEGVSTLIHDILAACP

SEQ ID NO: 280 - protein, 46 aa, ARTIFICIAL SEQUENCE
  Engineered albumin binding polypeptide
LAEAKVLANRELDKYGKSDFYKRLINRAKTVEGVSTLIHDILAAKP

SEQ ID NO: 281 - protein, 46 aa, ARTIFICIAL SEQUENCE
  Engineered albumin binding polypeptide
LAEAKVLANRELDKYGCSDFYKRLINRAKTVEGVQALISEILAAKP

SEQ ID NO: 282 - protein, 46 aa, ARTIFICIAL SEQUENCE
  Engineered albumin binding polypeptide
LAEAKVLANRELDKYGKSDFYKRLINRAKTVEGVQALISEILAACP

SEQ ID NO: 283 - protein, 46 aa, ARTIFICIAL SEQUENCE
  Engineered albumin binding polypeptide
LAEAKVLANRELDKYGCSDFYKRLINRAKTVEGVQALISEILAACP

SEQ ID NO: 284 - protein, 46 aa, ARTIFICIAL SEQUENCE
  Engineered albumin binding polypeptide
LAEAKVLANRELDKYGKSDFYKRLINRAKTVEGVQALISEILAAKP

SEQ ID NO: 285 - protein, 46 aa, ARTIFICIAL SEQUENCE
  Engineered albumin binding polypeptide
LAEAKVLANRELDKYGCSDYYKRLINKAKTVEGVDSLIVHILAAKP

SEQ ID NO: 286 - protein, 46 aa, ARTIFICIAL SEQUENCE
  Engineered albumin binding polypeptide
LAEAKVLANRELDKYGKSDYYKRLINKAKTVEGVDSLIVHILAACP

SEQ ID NO: 287 - protein, 46 aa, ARTIFICIAL SEQUENCE
  Engineered albumin binding polypeptide
LAEAKVLANRELDKYGCSDYYKRLINKAKTVEGVDSLIVHILAACP

SEQ ID NO: 288 - protein, 46 aa, ARTIFICIAL SEQUENCE
  Engineered albumin binding polypeptide
LAEAKVLANRELDKYGKSDYYKRLINKAKTVEGVDSLIVHILAAKP

SEQ ID NO: 289 - protein, 46 aa, ARTIFICIAL SEQUENCE
  Engineered albumin binding polypeptide
LAEAKVLANRELDKYGCSDFYKRLINRAKTVEGVQSLITEILAAKP

SEQ ID NO: 290 - protein, 46 aa, ARTIFICIAL SEQUENCE
  Engineered albumin binding polypeptide
LAEAKVLANRELDKYGKSDFYKRLINRAKTVEGVQSLITEILAACP

SEQ ID NO: 291 - protein, 46 aa, ARTIFICIAL SEQUENCE
  Engineered albumin binding polypeptide
LAEAKVLANRELDKYGCSDFYKRLINRAKTVEGVQSLITEILAACP

SEQ ID NO: 292 - protein, 46 aa, ARTIFICIAL SEQUENCE
  Engineered albumin binding polypeptide
LAEAKVLANRELDKYGKSDFYKRLINRAKTVEGVQSLITEILAAKP

SEQ ID NO: 293 - protein, 46 aa, ARTIFICIAL SEQUENCE
  Engineered albumin binding polypeptide
LAEAKVLANRELDKYGCSDYYKRLINRAKTVEGVDALITHILAAKP

SEQ ID NO: 294 - protein, 46 aa, ARTIFICIAL SEQUENCE
  Engineered albumin binding polypeptide
LAEAKVLANRELDKYGKSDYYKRLINRAKTVEGVDALITHILAACP

SEQ ID NO: 295 - protein, 46 aa, ARTIFICIAL SEQUENCE
  Engineered albumin binding polypeptide
LAEAKVLANRELDKYGCSDYYKRLINRAKTVEGVDALITHILAACP

SEQ ID NO: 296 - protein, 46 aa, ARTIFICIAL SEQUENCE
  Engineered albumin binding polypeptide
LAEAKVLANRELDKYGKSDYYKRLINRAKTVEGVDALITHILAAKP

SEQ ID NO: 297 - protein, 46 aa, ARTIFICIAL SEQUENCE
  Engineered albumin binding polypeptide
LAEAKVLANRELDKYGCSDFYKRMINRAKTVEGVDSLITHILAAKP

SEQ ID NO: 298 - protein, 46 aa, ARTIFICIAL SEQUENCE
  Engineered albumin binding polypeptide
LAEAKVLANRELDKYGKSDFYKRMINRAKTVEGVDSLITHILAACP

SEQ ID NO: 299 - protein, 46 aa, ARTIFICIAL SEQUENCE
  Engineered albumin binding polypeptide
LAEAKVLANRELDKYGCSDFYKRMINRAKTVEGVDSLITHILAACP

SEQ ID NO: 300 - protein, 46 aa, ARTIFICIAL SEQUENCE
  Engineered albumin binding polypeptide
LAEAKVLANRELDKYGKSDFYKRMINRAKTVEGVDSLITHILAAKP

SEQ ID NO: 301 - protein, 46 aa, ARTIFICIAL SEQUENCE
  Engineered albumin binding polypeptide
LAEAKVLANRELDKYGCSDFYKRLINRAKTVEGVTTLTTDILAAKP

SEQ ID NO: 302 - protein, 46 aa, ARTIFICIAL SEQUENCE
  Engineered albumin binding polypeptide
LAEAKVLANRELDKYGKSDFYKRLINRAKTVEGVTTLTTDILAACP

SEQ ID NO: 303 - protein, 46 aa, ARTIFICIAL SEQUENCE
  Engineered albumin binding polypeptide
LAEAKVLANRELDKYGCSDFYKRLINRAKTVEGVTTLTTDILAACP

SEQ ID NO: 304 - protein, 46 aa, ARTIFICIAL SEQUENCE
  Engineered albumin binding polypeptide
LAEAKVLANRELDKYGKSDFYKRLINRAKTVEGVTTLTTDILAAKP

SEQ ID NO: 305 - protein, 46 aa, ARTIFICIAL SEQUENCE
  Engineered albumin binding polypeptide
LAEAKVLANRELDKYGCSDFYKRLINRAKTVEGVESLIDHILAAKP

SEQ ID NO: 306 - protein, 46 aa, ARTIFICIAL SEQUENCE
  Engineered albumin binding polypeptide
LAEAKVLANRELDKYGKSDFYKRLINRAKTVEGVESLIDHILAACP

SEQ ID NO: 307 - protein, 46 aa, ARTIFICIAL SEQUENCE
  Engineered albumin binding polypeptide
LAEAKVLANRELDKYGCSDFYKRLINRAKTVEGVESLIDHILAACP

SEQ ID NO: 308 - protein, 46 aa, ARTIFICIAL SEQUENCE
  Engineered albumin binding polypeptide
LAEAKVLANRELDKYGKSDFYKRLINRAKTVEGVESLIDHILAAKP

SEQ ID NO: 309 - protein, 46 aa, ARTIFICIAL SEQUENCE
  Engineered albumin binding polypeptide
LAEAKVLANRELDKYGCSDFYKRYINRAKTVEGVHTLIGHILAAKP

SEQ ID NO: 310 - protein, 46 aa, ARTIFICIAL SEQUENCE
  Engineered albumin binding polypeptide
LAEAKVLANRELDKYGKSDFYKRYINRAKTVEGVHTLIGHILAACP

SEQ ID NO: 311 - protein, 46 aa, ARTIFICIAL SEQUENCE
  Engineered albumin binding polypeptide
LAEAKVLANRELDKYGCSDFYKRYINRAKTVEGVHTLIGHILAACP

SEQ ID NO: 312 - protein, 46 aa, ARTIFICIAL SEQUENCE
  Engineered albumin binding polypeptide
LAEAKVLANRELDKYGKSDFYKRYINRAKTVEGVHTLIGHILAAKP

SEQ ID NO: 313 - protein, 46 aa, ARTIFICIAL SEQUENCE
  Engineered albumin binding polypeptide
LAEAKVLANRELDKYGCSDFYKRLINRAKTVEGVQTLISDILAAKP

SEQ ID NO: 314 - protein, 46 aa, ARTIFICIAL SEQUENCE
  Engineered albumin binding polypeptide
LAEAKVLANRELDKYGKSDFYKRLINRAKTVEGVQTLISDILAACP

SEQ ID NO: 315 - protein, 46 aa, ARTIFICIAL SEQUENCE
  Engineered albumin binding polypeptide
LAEAKVLANRELDKYGCSDFYKRLINRAKTVEGVQTLISDILAACP

SEQ ID NO: 316 - protein, 46 aa, ARTIFICIAL SEQUENCE
  Engineered albumin binding polypeptide
LAEAKVLANRELDKYGKSDFYKRLINRAKTVEGVQTLISDILAAKP

SEQ ID NO: 317 - protein, 46 aa, ARTIFICIAL SEQUENCE
  Engineered albumin binding polypeptide
LAEAKVLANRELDKYGCSDFYKRLINRAKTVEGVNSLTSHILAAKP

SEQ ID NO: 318 - protein, 46 aa, ARTIFICIAL SEQUENCE
  Engineered albumin binding polypeptide
LAEAKVLANRELDKYGKSDFYKRLINRAKTVEGVNSLTSHILAACP

SEQ ID NO: 319 - protein, 46 aa, ARTIFICIAL SEQUENCE
  Engineered albumin binding polypeptide
LAEAKVLANRELDKYGCSDFYKRLINRAKTVEGVNSLTSHILAACP

SEQ ID NO: 320 - protein, 46 aa, ARTIFICIAL SEQUENCE
  Engineered albumin binding polypeptide
LAEAKVLANRELDKYGKSDFYKRLINRAKTVEGVNSLTSHILAAKP

SEQ ID NO: 321 - protein, 46 aa, ARTIFICIAL SEQUENCE
  Engineered albumin binding polypeptide
LAEAKVLANRELDKYGCSDFYKRLINRAKTVEGVNTLIHDILAAKP

SEQ ID NO: 322 - protein, 46 aa, ARTIFICIAL SEQUENCE
  Engineered albumin binding polypeptide
LAEAKVLANRELDKYGKSDFYKRLINRAKTVEGVNTLIHDILAACP

SEQ ID NO: 323 - protein, 46 aa, ARTIFICIAL SEQUENCE
  Engineered albumin binding polypeptide
LAEAKVLANRELDKYGCSDFYKRLINRAKTVEGVNTLIHDILAACP

SEQ ID NO: 324 - protein, 46 aa, ARTIFICIAL SEQUENCE
  Engineered albumin binding polypeptide
LAEAKVLANRELDKYGKSDFYKRLINRAKTVEGVNTLIHDILAAKP

SEQ ID NO: 325 - protein, 46 aa, ARTIFICIAL SEQUENCE
  Engineered albumin binding polypeptide
LAEAKVLANRELDKYGCSDFYKRLINRAKTVEGVESLIGEILAAKP

SEQ ID NO: 326 - protein, 46 aa, ARTIFICIAL SEQUENCE
  Engineered albumin binding polypeptide
LAEAKVLANRELDKYGKSDFYKRLINRAKTVEGVESLIGEILAACP

SEQ ID NO: 327 - protein, 46 aa, ARTIFICIAL SEQUENCE
  Engineered albumin binding polypeptide
LAEAKVLANRELDKYGCSDFYKRLINRAKTVEGVESLIGEILAACP

SEQ ID NO: 328 - protein, 46 aa, ARTIFICIAL SEQUENCE
  Engineered albumin binding polypeptide
LAEAKVLANRELDKYGKSDFYKRLINRAKTVEGVESLIGEILAAKP

SEQ ID NO: 329 - protein, 46 aa, ARTIFICIAL SEQUENCE
  Engineered albumin binding polypeptide
LAEAKVLANRELDKYGCSDFYKRLINKAKTVEGVHTLIHDILAAKP

SEQ ID NO: 330 - protein, 46 aa, ARTIFICIAL SEQUENCE
  Engineered albumin binding polypeptide
LAEAKVLANRELDKYGKSDFYKRLINKAKTVEGVHTLIHDILAACP

SEQ ID NO: 331 - protein, 46 aa, ARTIFICIAL SEQUENCE
  Engineered albumin binding polypeptide
LAEAKVLANRELDKYGCSDFYKRLINKAKTVEGVHTLIHDILAACP

SEQ ID NO: 332 - protein, 46 aa, ARTIFICIAL SEQUENCE
  Engineered albumin binding polypeptide
LAEAKVLANRELDKYGKSDFYKRLINKAKTVEGVHTLIHDILAAKP

SEQ ID NO: 333 - protein, 46 aa, ARTIFICIAL SEQUENCE
  Engineered albumin binding polypeptide
LAEAKVLANRELDKYGCSDYYKRLINKAKTVEGVSALKMHILAAKP

SEQ ID NO: 334 - protein, 46 aa, ARTIFICIAL SEQUENCE
  Engineered albumin binding polypeptide
LAEAKVLANRELDKYGKSDYYKRLINKAKTVEGVSALKMHILAACP

SEQ ID NO: 335 - protein, 46 aa, ARTIFICIAL SEQUENCE
  Engineered albumin binding polypeptide
LAEAKVLANRELDKYGCSDYYKRLINKAKTVEGVSALKMHILAACP

SEQ ID NO: 336 - protein, 46 aa, ARTIFICIAL SEQUENCE
  Engineered albumin binding polypeptide
LAEAKVLANRELDKYGKSDYYKRLINKAKTVEGVSALKMHILAAKP

SEQ ID NO: 337 - protein, 46 aa, ARTIFICIAL SEQUENCE
  Engineered albumin binding polypeptide
LAEAKVLANRELDKYGCSDFYKRLINKAKTVEGVDALIVHILAAKP

SEQ ID NO: 338 - protein, 46 aa, ARTIFICIAL SEQUENCE
  Engineered albumin binding polypeptide
LAEAKVLANRELDKYGKSDFYKRLINKAKTVEGVDALIVHILAACP

SEQ ID NO: 339 - protein, 46 aa, ARTIFICIAL SEQUENCE
  Engineered albumin binding polypeptide
LAEAKVLANRELDKYGCSDFYKRLINKAKTVEGVDALIVHILAACP

SEQ ID NO: 340 - protein, 46 aa, ARTIFICIAL SEQUENCE
  Engineered albumin binding polypeptide
LAEAKVLANRELDKYGKSDFYKRLINKAKTVEGVDALIVHILAAKP

SEQ ID NO: 341 - protein, 46 aa, ARTIFICIAL SEQUENCE
  Engineered albumin binding polypeptide
LAEAKVLANRELDKYGCSDYYKRLINRARTVEGVDTLIHDILAAKP

SEQ ID NO: 342 - protein, 46 aa, ARTIFICIAL SEQUENCE
  Engineered albumin binding polypeptide
LAEAKVLANRELDKYGKSDYYKRLINRARTVEGVDTLIHDILAACP

SEQ ID NO: 343 - protein, 46 aa, ARTIFICIAL SEQUENCE
  Engineered albumin binding polypeptide
LAEAKVLANRELDKYGCSDYYKRLINRARTVEGVDTLIHDILAACP

SEQ ID NO: 344 - protein, 46 aa, ARTIFICIAL SEQUENCE
  Engineered albumin binding polypeptide
LAEAKVLANRELDKYGKSDYYKRLINRARTVEGVDTLIHDILAAKP

SEQ ID NO: 345 - protein, 46 aa, ARTIFICIAL SEQUENCE
  Engineered albumin binding polypeptide
LAEAKVLANRELDKYGCSDFYKRVINRARTVEGVQALIADILAAKP

SEQ ID NO: 346 - protein, 46 aa, ARTIFICIAL SEQUENCE
  Engineered albumin binding polypeptide
LAEAKVLANRELDKYGKSDFYKRVINRARTVEGVQALIADILAACP

SEQ ID NO: 347 - protein, 46 aa, ARTIFICIAL SEQUENCE
  Engineered albumin binding polypeptide
LAEAKVLANRELDKYGCSDFYKRVINRARTVEGVQALIADILAACP

SEQ ID NO: 348 - protein, 46 aa, ARTIFICIAL SEQUENCE
  Engineered albumin binding polypeptide
LAEAKVLANRELDKYGKSDFYKRVINRARTVEGVQALIADILAAKP

SEQ ID NO: 349 - protein, 46 aa, ARTIFICIAL SEQUENCE
  Engineered albumin binding polypeptide
LAEAKVLANRELDKYGCSDFYKRLINRAKTVEGVESLIADILAAKP

SEQ ID NO: 350 - protein, 46 aa, ARTIFICIAL SEQUENCE
  Engineered albumin binding polypeptide
LAEAKVLANRELDKYGKSDFYKRLINRAKTVEGVESLIADILAACP

SEQ ID NO: 351 - protein, 46 aa, ARTIFICIAL SEQUENCE
  Engineered albumin binding polypeptide
LAEAKVLANRELDKYGCSDFYKRLINRAKTVEGVESLIADILAACP

SEQ ID NO: 352 - protein, 46 aa, ARTIFICIAL SEQUENCE
  Engineered albumin binding polypeptide
LAEAKVLANRELDKYGKSDFYKRLINRAKTVEGVESLIADILAAKP

SEQ ID NO: 353 - protein, 46 aa, ARTIFICIAL SEQUENCE
  Engineered albumin binding polypeptide
LAEAKVLANRELDKYGCSDYYKRLINKAKTVEGVDALIAHILAAKP

SEQ ID NO: 354 - protein, 46 aa, ARTIFICIAL SEQUENCE
  Engineered albumin binding polypeptide
LAEAKVLANRELDKYGKSDYYKRLINKAKTVEGVDALIAHILAACP

SEQ ID NO: 355 - protein, 46 aa, ARTIFICIAL SEQUENCE
  Engineered albumin binding polypeptide
LAEAKVLANRELDKYGCSDYYKRLINKAKTVEGVDALIAHILAACP

SEQ ID NO: 356 - protein, 46 aa, ARTIFICIAL SEQUENCE
  Engineered albumin binding polypeptide
LAEAKVLANRELDKYGKSDYYKRLINKAKTVEGVDALIAHILAAKP

SEQ ID NO: 357 - protein, 46 aa, ARTIFICIAL SEQUENCE
  Engineered albumin binding polypeptide
LAEAKVLANRELDKYGCSDYYKRLINRAKTVEGVESLITHILAAKP

SEQ ID NO: 358 - protein, 46 aa, ARTIFICIAL SEQUENCE
  Engineered albumin binding polypeptide
LAEAKVLANRELDKYGKSDYYKRLINRAKTVEGVESLITHILAACP

SEQ ID NO: 359 - protein, 46 aa, ARTIFICIAL SEQUENCE
  Engineered albumin binding polypeptide
LAEAKVLANRELDKYGCSDYYKRLINRAKTVEGVESLITHILAACP

SEQ ID NO: 360 - protein, 46 aa, ARTIFICIAL SEQUENCE
  Engineered albumin binding polypeptide
LAEAKVLANRELDKYGKSDYYKRLINRAKTVEGVESLITHILAAKP

SEQ ID NO: 361 - protein, 46 aa, ARTIFICIAL SEQUENCE
  Engineered albumin binding polypeptide
LAEAKVLANRELDKYGCSDFYKRLINRARTVEGVDSLIVEILAAKP

SEQ ID NO: 362 - protein, 46 aa, ARTIFICIAL SEQUENCE
  Engineered albumin binding polypeptide
LAEAKVLANRELDKYGKSDFYKRLINRARTVEGVDSLIVEILAACP

SEQ ID NO: 363 - protein, 46 aa, ARTIFICIAL SEQUENCE
  Engineered albumin binding polypeptide
LAEAKVLANRELDKYGCSDFYKRLINRARTVEGVDSLIVEILAACP

SEQ ID NO: 364 - protein, 46 aa, ARTIFICIAL SEQUENCE
  Engineered albumin binding polypeptide
LAEAKVLANRELDKYGKSDFYKRLINRARTVEGVDSLIVEILAAKP

SEQ ID NO: 365 - protein, 46 aa, ARTIFICIAL SEQUENCE
  Engineered albumin binding polypeptide
LAEAKVLANRELDKYGCSDFYKRVINRAKTVEGVSALIREILAAKP

SEQ ID NO: 366 - protein, 46 aa, ARTIFICIAL SEQUENCE
  Engineered albumin binding polypeptide
LAEAKVLANRELDKYGKSDFYKRVINRAKTVEGVSALIREILAACP

SEQ ID NO: 367 - protein, 46 aa, ARTIFICIAL SEQUENCE
  Engineered albumin binding polypeptide
LAEAKVLANRELDKYGCSDFYKRVINRAKTVEGVSALIREILAACP

SEQ ID NO: 368 - protein, 46 aa, ARTIFICIAL SEQUENCE
  Engineered albumin binding polypeptide
LAEAKVLANRELDKYGKSDFYKRVINRAKTVEGVSALIREILAAKP

SEQ ID NO: 369 - protein, 46 aa, ARTIFICIAL SEQUENCE
  Engineered albumin binding polypeptide
LAEAKVLANRELDKYGCSDFYKRLINRAKTVEGVNALISDILAAKP

SEQ ID NO: 370 - protein, 46 aa, ARTIFICIAL SEQUENCE
  Engineered albumin binding polypeptide
LAEAKVLANRELDKYGKSDFYKRLINRAKTVEGVNALISDILAACP

SEQ ID NO: 371 - protein, 46 aa, ARTIFICIAL SEQUENCE
  Engineered albumin binding polypeptide
LAEAKVLANRELDKYGCSDFYKRLINRAKTVEGVNALISDILAACP

SEQ ID NO: 372 - protein, 46 aa, ARTIFICIAL SEQUENCE
  Engineered albumin binding polypeptide
LAEAKVLANRELDKYGKSDFYKRLINRAKTVEGVNALISDILAAKP

SEQ ID NO: 373 - protein, 46 aa, ARTIFICIAL SEQUENCE
  Engineered albumin binding polypeptide
LAEAKVLANRELDKYGCSDFYKRLINRAKTVEGVSALIQEILAAKP

SEQ ID NO: 374 - protein, 46 aa, ARTIFICIAL SEQUENCE
  Engineered albumin binding polypeptide
LAEAKVLANRELDKYGKSDFYKRLINRAKTVEGVSALIQEILAACP

SEQ ID NO: 375 - protein, 46 aa, ARTIFICIAL SEQUENCE
  Engineered albumin binding polypeptide
LAEAKVLANRELDKYGCSDFYKRLINRAKTVEGVSALIQEILAACP

SEQ ID NO: 376 - protein, 46 aa, ARTIFICIAL SEQUENCE
  Engineered albumin binding polypeptide
LAEAKVLANRELDKYGKSDFYKRLINRAKTVEGVSALIQEILAAKP

SEQ ID NO: 377 - protein, 46 aa, ARTIFICIAL SEQUENCE
  Engineered albumin binding polypeptide
LAEAKVLANRELDKYGCSDFYKRLINRAKTVEGVQSLIDHILAAKP

SEQ ID NO: 378 - protein, 46 aa, ARTIFICIAL SEQUENCE
  Engineered albumin binding polypeptide
LAEAKVLANRELDKYGKSDFYKRLINRAKTVEGVQSLIDHILAACP

SEQ ID NO: 379 - protein, 46 aa, ARTIFICIAL SEQUENCE
  Engineered albumin binding polypeptide
LAEAKVLANRELDKYGCSDFYKRLINRAKTVEGVQSLIDHILAACP

SEQ ID NO: 380 - protein, 46 aa, ARTIFICIAL SEQUENCE
  Engineered albumin binding polypeptide
LAEAKVLANRELDKYGKSDFYKRLINRAKTVEGVQSLIDHILAAKP

SEQ ID NO: 381 - protein, 46 aa, ARTIFICIAL SEQUENCE
  Engineered albumin binding polypeptide
LAEAKVLANRELDKYGCSDFYKRLINRAKTVEGVDALICHILAAKP

SEQ ID NO: 382 - protein, 46 aa, ARTIFICIAL SEQUENCE
  Engineered albumin binding polypeptide
LAEAKVLANRELDKYGKSDFYKRLINRAKTVEGVDALICHILAACP

SEQ ID NO: 383 - protein, 46 aa, ARTIFICIAL SEQUENCE
  Engineered albumin binding polypeptide
LAEAKVLANRELDKYGCSDFYKRLINRAKTVEGVDALICHILAACP

SEQ ID NO: 384 - protein, 46 aa, ARTIFICIAL SEQUENCE
  Engineered albumin binding polypeptide
LAEAKVLANRELDKYGKSDFYKRLINRAKTVEGVDALICHILAAKP

SEQ ID NO: 385 - protein, 46 aa, ARTIFICIAL SEQUENCE
  Engineered albumin binding polypeptide
LAEAKVLANRELDKYGCSDFYKRVINKAKTVEGVEALIADILAAKP

SEQ ID NO: 386 - protein, 46 aa, ARTIFICIAL SEQUENCE
  Engineered albumin binding polypeptide
LAEAKVLANRELDKYGKSDFYKRVINKAKTVEGVEALIADILAACP

SEQ ID NO: 387 - protein, 46 aa, ARTIFICIAL SEQUENCE
  Engineered albumin binding polypeptide
LAEAKVLANRELDKYGCSDFYKRVINKAKTVEGVEALIADILAACP

SEQ ID NO: 388 - protein, 46 aa, ARTIFICIAL SEQUENCE
  Engineered albumin binding polypeptide
LAEAKVLANRELDKYGKSDFYKRVINKAKTVEGVEALIADILAAKP

SEQ ID NO: 389 - protein, 46 aa, ARTIFICIAL SEQUENCE
  Engineered albumin binding polypeptide
LAEAKVLANRELDKYGCSDFYKRLINRAKTVEGVETLIRDILAAKP

SEQ ID NO: 390 - protein, 46 aa, ARTIFICIAL SEQUENCE
  Engineered albumin binding polypeptide
LAEAKVLANRELDKYGKSDFYKRLINRAKTVEGVETLIRDILAACP

SEQ ID NO: 391 - protein, 46 aa, ARTIFICIAL SEQUENCE
  Engineered albumin binding polypeptide
LAEAKVLANRELDKYGCSDFYKRLINRAKTVEGVETLIRDILAACP

SEQ ID NO: 392 - protein, 46 aa, ARTIFICIAL SEQUENCE
  Engineered albumin binding polypeptide
LAEAKVLANRELDKYGKSDFYKRLINRAKTVEGVETLIRDILAAKP

SEQ ID NO: 393 - protein, 46 aa, ARTIFICIAL SEQUENCE
  Engineered albumin binding polypeptide
LAEAKVLANRELDKYGCSDFYKRLINRARTVEGVQTLITDILAAKP

SEQ ID NO: 394 - protein, 46 aa, ARTIFICIAL SEQUENCE
  Engineered albumin binding polypeptide
LAEAKVLANRELDKYGKSDFYKRLINRARTVEGVQTLITDILAACP

SEQ ID NO: 395 - protein, 46 aa, ARTIFICIAL SEQUENCE
  Engineered albumin binding polypeptide
LAEAKVLANRELDKYGCSDFYKRLINRARTVEGVQTLITDILAACP

SEQ ID NO: 396 - protein, 46 aa, ARTIFICIAL SEQUENCE
  Engineered albumin binding polypeptide
LAEAKVLANRELDKYGKSDFYKRLINRARTVEGVQTLITDILAAKP

SEQ ID NO: 397 - protein, 46 aa, ARTIFICIAL SEQUENCE
  Engineered albumin binding polypeptide
LAEAKVLANRELDKYGCSDYYKRLINRAKTVEGVQALIAHILAAKP

SEQ ID NO: 398 - protein, 46 aa, ARTIFICIAL SEQUENCE
  Engineered albumin binding polypeptide
LAEAKVLANRELDKYGKSDYYKRLINRAKTVEGVQALIAHILAACP

SEQ ID NO: 399 - protein, 46 aa, ARTIFICIAL SEQUENCE
  Engineered albumin binding polypeptide
LAEAKVLANRELDKYGCSDYYKRLINRAKTVEGVQALIAHILAACP

SEQ ID NO: 400 - protein, 46 aa, ARTIFICIAL SEQUENCE
  Engineered albumin binding polypeptide
LAEAKVLANRELDKYGKSDYYKRLINRAKTVEGVQALIAHILAAKP

SEQ ID NO: 401 - protein, 46 aa, ARTIFICIAL SEQUENCE
  Engineered albumin binding polypeptide
LAEAKVLANRELDKYGCSDFYKRVINRAKTVEGVNSLINHILAAKP

SEQ ID NO: 402 - protein, 46 aa, ARTIFICIAL SEQUENCE
  Engineered albumin binding polypeptide
LAEAKVLANRELDKYGKSDFYKRVINRAKTVEGVNSLINHILAACP

SEQ ID NO: 403 - protein, 46 aa, ARTIFICIAL SEQUENCE
  Engineered albumin binding polypeptide
LAEAKVLANRELDKYGCSDFYKRVINRAKTVEGVNSLINHILAACP

SEQ ID NO: 404 - protein, 46 aa, ARTIFICIAL SEQUENCE
  Engineered albumin binding polypeptide
LAEAKVLANRELDKYGKSDFYKRVINRAKTVEGVNSLINHILAAKP

SEQ ID NO: 405 - protein, 46 aa, ARTIFICIAL SEQUENCE
  Engineered albumin binding polypeptide
LAEAKVLANRELDKYGCSDFYKRLINRARTVEGVDSLIRHILAAKP

SEQ ID NO: 406 - protein, 46 aa, ARTIFICIAL SEQUENCE
  Engineered albumin binding polypeptide
LAEAKVLANRELDKYGKSDFYKRLINRARTVEGVDSLIRHILAACP

SEQ ID NO: 407 - protein, 46 aa, ARTIFICIAL SEQUENCE
  Engineered albumin binding polypeptide
LAEAKVLANRELDKYGCSDFYKRLINRARTVEGVDSLIRHILAACP

SEQ ID NO: 408 - protein, 46 aa, ARTIFICIAL SEQUENCE
  Engineered albumin binding polypeptide
LAEAKVLANRELDKYGKSDFYKRLINRARTVEGVDSLIRHILAAKP

SEQ ID NO: 409 - protein, 46 aa, ARTIFICIAL SEQUENCE
  Engineered albumin binding polypeptide
LAEAKVLANRELDKYGCSDYYKRLINKAKTVEGVEALTLHILAAKP

SEQ ID NO: 410 - protein, 46 aa, ARTIFICIAL SEQUENCE
  Engineered albumin binding polypeptide
LAEAKVLANRELDKYGKSDYYKRLINKAKTVEGVEALTLHILAACP

SEQ ID NO: 411 - protein, 46 aa, ARTIFICIAL SEQUENCE
  Engineered albumin binding polypeptide
LAEAKVLANRELDKYGCSDYYKRLINKAKTVEGVEALTLHILAACP

SEQ ID NO: 412 - protein, 46 aa, ARTIFICIAL SEQUENCE
  Engineered albumin binding polypeptide
LAEAKVLANRELDKYGKSDYYKRLINKAKTVEGVEALTLHILAAKP

SEQ ID NO: 413 - protein, 46 aa, ARTIFICIAL SEQUENCE
  Engineered albumin binding polypeptide
LAEAKVLANRELDKYGCSDFYKRLINRAKTVEGVDALIAHILAAKP

SEQ ID NO: 414 - protein, 46 aa, ARTIFICIAL SEQUENCE
  Engineered albumin binding polypeptide
LAEAKVLANRELDKYGKSDFYKRLINRAKTVEGVDALIAHILAACP

SEQ ID NO: 415 - protein, 46 aa, ARTIFICIAL SEQUENCE
  Engineered albumin binding polypeptide
LAEAKVLANRELDKYGCSDFYKRLINRAKTVEGVDALIAHILAACP

SEQ ID NO: 416 - protein, 46 aa, ARTIFICIAL SEQUENCE
  Engineered albumin binding polypeptide
LAEAKVLANRELDKYGKSDFYKRLINRAKTVEGVDALIAHILAAKP

SEQ ID NO: 417 - protein, 46 aa, ARTIFICIAL SEQUENCE
  Engineered albumin binding polypeptide
LAEAKVLANRELDKYGCSDYYKRLINKAKTVEGVQALIAHILAAKP

SEQ ID NO: 418 - protein, 46 aa, ARTIFICIAL SEQUENCE
  Engineered albumin binding polypeptide
LAEAKVLANRELDKYGKSDYYKRLINKAKTVEGVQALIAHILAACP

SEQ ID NO: 419 - protein, 46 aa, ARTIFICIAL SEQUENCE
  Engineered albumin binding polypeptide
LAEAKVLANRELDKYGCSDYYKRLINKAKTVEGVQALIAHILAACP

SEQ ID NO: 420 - protein, 46 aa, ARTIFICIAL SEQUENCE
  Engineered albumin binding polypeptide
LAEAKVLANRELDKYGKSDYYKRLINKAKTVEGVQALIAHILAAKP

SEQ ID NO: 421 - protein, 46 aa, ARTIFICIAL SEQUENCE
  Engineered albumin binding polypeptide
LAEAKVLANRELDKYGCSDFYKNLINRAKTVEGVHALKGHILAAKP

SEQ ID NO: 422 - protein, 46 aa, ARTIFICIAL SEQUENCE
  Engineered albumin binding polypeptide
LAEAKVLANRELDKYGKSDFYKNLINRAKTVEGVHALKGHILAACP

SEQ ID NO: 423 - protein, 46 aa, ARTIFICIAL SEQUENCE
  Engineered albumin binding polypeptide
LAEAKVLANRELDKYGCSDFYKNLINRAKTVEGVHALKGHILAACP

SEQ ID NO: 424 - protein, 46 aa, ARTIFICIAL SEQUENCE
  Engineered albumin binding polypeptide
LAEAKVLANRELDKYGKSDFYKNLINRAKTVEGVHALKGHILAAKP

SEQ ID NO: 425 - protein, 46 aa, ARTIFICIAL SEQUENCE
  Engineered albumin binding polypeptide
LAEAKVLANRELDKYGCSDFYKNVINRAKTVEGVHALKDHILAAKP

SEQ ID NO: 426 - protein, 46 aa, ARTIFICIAL SEQUENCE
  Engineered albumin binding polypeptide
LAEAKVLANRELDKYGKSDFYKNVINRAKTVEGVHALKDHILAACP

SEQ ID NO: 427 - protein, 46 aa, ARTIFICIAL SEQUENCE
  Engineered albumin binding polypeptide
LAEAKVLANRELDKYGCSDFYKNVINRAKTVEGVHALKDHILAACP

SEQ ID NO: 428 - protein, 46 aa, ARTIFICIAL SEQUENCE
  Engineered albumin binding polypeptide
LAEAKVLANRELDKYGKSDFYKNVINRAKTVEGVHALKDHILAAKP

SEQ ID NO: 429 - protein, 46 aa, ARTIFICIAL SEQUENCE
  Engineered albumin binding polypeptide
LAEAKVLANRELDKYGCSDFYKNVINRAKTVEGVSALKHEILAAKP

SEQ ID NO: 430 - protein, 46 aa, ARTIFICIAL SEQUENCE
  Engineered albumin binding polypeptide
LAEAKVLANRELDKYGKSDFYKNVINRAKTVEGVSALKHEILAACP

SEQ ID NO: 431 - protein, 46 aa, ARTIFICIAL SEQUENCE
  Engineered albumin binding polypeptide
LAEAKVLANRELDKYGCSDFYKNVINRAKTVEGVSALKHEILAACP

SEQ ID NO: 432 - protein, 46 aa, ARTIFICIAL SEQUENCE
  Engineered albumin binding polypeptide
LAEAKVLANRELDKYGKSDFYKNVINRAKTVEGVSALKHEILAAKP

SEQ ID NO: 433 - protein, 46 aa, ARTIFICIAL SEQUENCE
  Engineered albumin binding polypeptide
LAEAKVLANRELDKYGCSDFYKRLINRAKTVEGVNTLKADILAAKP

SEQ ID NO: 434 - protein, 46 aa, ARTIFICIAL SEQUENCE
  Engineered albumin binding polypeptide
LAEAKVLANRELDKYGKSDFYKRLINRAKTVEGVNTLKADILAACP

SEQ ID NO: 435 - protein, 46 aa, ARTIFICIAL SEQUENCE
  Engineered albumin binding polypeptide
LAEAKVLANRELDKYGCSDFYKRLINRAKTVEGVNTLKADILAACP

SEQ ID NO: 436 - protein, 46 aa, ARTIFICIAL SEQUENCE
  Engineered albumin binding polypeptide
LAEAKVLANRELDKYGKSDFYKRLINRAKTVEGVNTLKADILAAKP

SEQ ID NO: 437 - protein, 46 aa, ARTIFICIAL SEQUENCE
  Engineered albumin binding polypeptide
LAEAKVLANRELDKYGCSDFYKNLINRAKTVEGVNTLKADILAAKP

SEQ ID NO: 438 - protein, 46 aa, ARTIFICIAL SEQUENCE
  Engineered albumin binding polypeptide
LAEAKVLANRELDKYGKSDFYKNLINRAKTVEGVNTLKADILAACP

SEQ ID NO: 439 - protein, 46 aa, ARTIFICIAL SEQUENCE
  Engineered albumin binding polypeptide
LAEAKVLANRELDKYGCSDFYKNLINRAKTVEGVNTLKADILAACP

SEQ ID NO: 440 - protein, 46 aa, ARTIFICIAL SEQUENCE
  Engineered albumin binding polypeptide
LAEAKVLANRELDKYGKSDFYKNLINRAKTVEGVNTLKADILAAKP

SEQ ID NO: 441 - protein, 46 aa, ARTIFICIAL SEQUENCE
  Engineered albumin binding polypeptide
LAEAKVLANRELDKYGCSDYYKNLINRAKTVEGVNSLKSHILAAKP

SEQ ID NO: 442 - protein, 46 aa, ARTIFICIAL SEQUENCE
  Engineered albumin binding polypeptide
LAEAKVLANRELDKYGKSDYYKNLINRAKTVEGVNSLKSHILAACP

SEQ ID NO: 443 - protein, 46 aa, ARTIFICIAL SEQUENCE
  Engineered albumin binding polypeptide
LAEAKVLANRELDKYGCSDYYKNLINRAKTVEGVNSLKSHILAACP

SEQ ID NO: 444 - protein, 46 aa, ARTIFICIAL SEQUENCE
  Engineered albumin binding polypeptide
LAEAKVLANRELDKYGKSDYYKNLINRAKTVEGVNSLKSHILAAKP

SEQ ID NO: 445 - protein, 46 aa, ARTIFICIAL SEQUENCE
  Engineered albumin binding polypeptide
LAEAKVLANRELDKYGCSDFYKRLINRAKTVGGVQSLKSEILAAKP

SEQ ID NO: 446 - protein, 46 aa, ARTIFICIAL SEQUENCE
  Engineered albumin binding polypeptide
LAEAKVLANRELDKYGKSDFYKRLINRAKTVGGVQSLKSEILAACP

SEQ ID NO: 447 - protein, 46 aa, ARTIFICIAL SEQUENCE
  Engineered albumin binding polypeptide
LAEAKVLANRELDKYGCSDFYKRLINRAKTVGGVQSLKSEILAACP

SEQ ID NO: 448 - protein, 46 aa, ARTIFICIAL SEQUENCE
  Engineered albumin binding polypeptide
LAEAKVLANRELDKYGKSDFYKRLINRAKTVGGVQSLKSEILAAKP

SEQ ID NO: 449 - protein, 46 aa, ARTIFICIAL SEQUENCE
  Engineered albumin binding polypeptide
LAEAKVLANRELDKYGCSDFYKNVINRAKTVEGVDSLKAEILAAKP

SEQ ID NO: 450 - protein, 46 aa, ARTIFICIAL SEQUENCE
  Engineered albumin binding polypeptide
LAEAKVLANRELDKYGKSDFYKNVINRAKTVEGVDSLKAEILAACP

SEQ ID NO: 451 - protein, 46 aa, ARTIFICIAL SEQUENCE
  Engineered albumin binding polypeptide
LAEAKVLANRELDKYGCSDFYKNVINRAKTVEGVDSLKAEILAACP

SEQ ID NO: 452 - protein, 46 aa, ARTIFICIAL SEQUENCE
  Engineered albumin binding polypeptide
LAEAKVLANRELDKYGKSDFYKNVINRAKTVEGVDSLKAEILAAKP

SEQ ID NO: 453 - protein, 46 aa, ARTIFICIAL SEQUENCE
  Engineered albumin binding polypeptide
LAEAKVLANRELDKYGCSDFYKNLINRARTVEGVQTLKSDILAAKP

SEQ ID NO: 454 - protein, 46 aa, ARTIFICIAL SEQUENCE
  Engineered albumin binding polypeptide
LAEAKVLANRELDKYGKSDFYKNLINRARTVEGVQTLKSDILAACP

SEQ ID NO: 455 - protein, 46 aa, ARTIFICIAL SEQUENCE
  Engineered albumin binding polypeptide
LAEAKVLANRELDKYGCSDFYKNLINRARTVEGVQTLKSDILAACP

SEQ ID NO: 456 - protein, 46 aa, ARTIFICIAL SEQUENCE
  Engineered albumin binding polypeptide
LAEAKVLANRELDKYGKSDFYKNLINRARTVEGVQTLKSDILAAKP

SEQ ID NO: 457 - protein, 46 aa, ARTIFICIAL SEQUENCE
  Engineered albumin binding polypeptide
LAEAKVLANRELDKYGCSDFYKKFINKAKTVEGVETLKSEILAAKP

SEQ ID NO: 458 - protein, 46 aa, ARTIFICIAL SEQUENCE
  Engineered albumin binding polypeptide
LAEAKVLANRELDKYGKSDFYKKFINKAKTVEGVETLKSEILAACP

SEQ ID NO: 459 - protein, 46 aa, ARTIFICIAL SEQUENCE
  Engineered albumin binding polypeptide
LAEAKVLANRELDKYGCSDFYKKFINKAKTVEGVETLKSEILAACP

SEQ ID NO: 460 - protein, 46 aa, ARTIFICIAL SEQUENCE
  Engineered albumin binding polypeptide
LAEAKVLANRELDKYGKSDFYKKFINKAKTVEGVETLKSEILAAKP

SEQ ID NO: 461 - protein, 46 aa, ARTIFICIAL SEQUENCE
  Engineered albumin binding polypeptide
LAEAKVLANRELDKYGCSDFYKSLINRAKTVEGVHSLKDEILAAKP

SEQ ID NO: 462 - protein, 46 aa, ARTIFICIAL SEQUENCE
  Engineered albumin binding polypeptide
LAEAKVLANRELDKYGKSDFYKSLINRAKTVEGVHSLKDEILAACP

SEQ ID NO: 463 - protein, 46 aa, ARTIFICIAL SEQUENCE
  Engineered albumin binding polypeptide
LAEAKVLANRELDKYGCSDFYKSLINRAKTVEGVHSLKDEILAACP

SEQ ID NO: 464 - protein, 46 aa, ARTIFICIAL SEQUENCE
  Engineered albumin binding polypeptide
LAEAKVLANRELDKYGKSDFYKSLINRAKTVEGVHSLKDEILAAKP

SEQ ID NO: 465 - protein, 46 aa, ARTIFICIAL SEQUENCE
  Engineered albumin binding polypeptide
LAEAKVLANRELDKYGCSDYYKNVINKAKTVEGVSSLKAEILAAKP

SEQ ID NO: 466 - protein, 46 aa, ARTIFICIAL SEQUENCE
  Engineered albumin binding polypeptide
LAEAKVLANRELDKYGKSDYYKNVINKAKTVEGVSSLKAEILAACP

SEQ ID NO: 467 - protein, 46 aa, ARTIFICIAL SEQUENCE
  Engineered albumin binding polypeptide
LAEAKVLANRELDKYGCSDYYKNVINKAKTVEGVSSLKAEILAACP

SEQ ID NO: 468 - protein, 46 aa, ARTIFICIAL SEQUENCE
  Engineered albumin binding polypeptide
LAEAKVLANRELDKYGKSDYYKNVINKAKTVEGVSSLKAEILAAKP

SEQ ID NO: 469 - protein, 46 aa, ARTIFICIAL SEQUENCE
  Engineered albumin binding polypeptide
LAEAKVLANRELDKYGCSDFYKSLINRAKTVEGVDALKSHILAAKP

SEQ ID NO: 470 - protein, 46 aa, ARTIFICIAL SEQUENCE
  Engineered albumin binding polypeptide
LAEAKVLANRELDKYGKSDFYKSLINRAKTVEGVDALKSHILAACP

SEQ ID NO: 471 - protein, 46 aa, ARTIFICIAL SEQUENCE
  Engineered albumin binding polypeptide
LAEAKVLANRELDKYGCSDFYKSLINRAKTVEGVDALKSHILAACP

SEQ ID NO: 472 - protein, 46 aa, ARTIFICIAL SEQUENCE
  Engineered albumin binding polypeptide
LAEAKVLANRELDKYGKSDFYKSLINRAKTVEGVDALKSHILAAKP

SEQ ID NO: 473 - protein, 46 aa, ARTIFICIAL SEQUENCE
  Engineered albumin binding polypeptide
LAEAKVLANRELDKYGCSDFYKNLINKAKTVEGVSTLKHDILAAKP

SEQ ID NO: 474 - protein, 46 aa, ARTIFICIAL SEQUENCE
  Engineered albumin binding polypeptide
LAEAKVLANRELDKYGKSDFYKNLINKAKTVEGVSTLKHDILAACP

SEQ ID NO: 475 - protein, 46 aa, ARTIFICIAL SEQUENCE
  Engineered albumin binding polypeptide
LAEAKVLANRELDKYGCSDFYKNLINKAKTVEGVSTLKHDILAACP

SEQ ID NO: 476 - protein, 46 aa, ARTIFICIAL SEQUENCE
  Engineered albumin binding polypeptide
LAEAKVLANRELDKYGKSDFYKNLINKAKTVEGVSTLKHDILAAKP

SEQ ID NO: 477 - protein, 46 aa, ARTIFICIAL SEQUENCE
  Engineered albumin binding polypeptide
LAEAKVLANRELDKYGCSDFYKNLINRAKTVEGVSTLKHDILAAKP

SEQ ID NO: 478 - protein, 46 aa, ARTIFICIAL SEQUENCE
  Engineered albumin binding polypeptide
LAEAKVLANRELDKYGKSDFYKNLINRAKTVEGVSTLKHDILAACP

SEQ ID NO: 479 - protein, 46 aa, ARTIFICIAL SEQUENCE
  Engineered albumin binding polypeptide
LAEAKVLANRELDKYGCSDFYKNLINRAKTVEGVSTLKHDILAACP

SEQ ID NO: 480 - protein, 46 aa, ARTIFICIAL SEQUENCE
  Engineered albumin binding polypeptide
LAEAKVLANRELDKYGKSDFYKNLINRAKTVEGVSTLKHDILAAKP

SEQ ID NO: 481 - protein, 46 aa, ARTIFICIAL SEQUENCE
  Engineered albumin binding polypeptide
LAEAKVLANRELDKYGCSDFYKNLINRAKTVEGVQALKSEILAAKP

SEQ ID NO: 482 - protein, 46 aa, ARTIFICIAL SEQUENCE
  Engineered albumin binding polypeptide
LAEAKVLANRELDKYGKSDFYKNLINRAKTVEGVQALKSEILAACP

SEQ ID NO: 483 - protein, 46 aa, ARTIFICIAL SEQUENCE
  Engineered albumin binding polypeptide
LAEAKVLANRELDKYGCSDFYKNLINRAKTVEGVQALKSEILAACP

SEQ ID NO: 484 - protein, 46 aa, ARTIFICIAL SEQUENCE
  Engineered albumin binding polypeptide
LAEAKVLANRELDKYGKSDFYKNLINRAKTVEGVQALKSEILAAKP

SEQ ID NO: 485 - protein, 46 aa, ARTIFICIAL SEQUENCE
  Engineered albumin binding polypeptide
LAEAKVLANRELDKYGCSDYYKSLINKAKTVEGVDSLKVHILAAKP

SEQ ID NO: 486 - protein, 46 aa, ARTIFICIAL SEQUENCE
  Engineered albumin binding polypeptide
LAEAKVLANRELDKYGKSDYYKSLINKAKTVEGVDSLKVHILAACP

SEQ ID NO: 487 - protein, 46 aa, ARTIFICIAL SEQUENCE
  Engineered albumin binding polypeptide
LAEAKVLANRELDKYGCSDYYKSLINKAKTVEGVDSLKVHILAACP

SEQ ID NO: 488 - protein, 46 aa, ARTIFICIAL SEQUENCE
  Engineered albumin binding polypeptide
LAEAKVLANRELDKYGKSDYYKSLINKAKTVEGVDSLKVHILAAKP

SEQ ID NO: 489 - protein, 46 aa, ARTIFICIAL SEQUENCE
  Engineered albumin binding polypeptide
LAEAKVLANRELDKYGCSDFYKNLINRAKTVEGVQSLKTEILAAKP

SEQ ID NO: 490 - protein, 46 aa, ARTIFICIAL SEQUENCE
  Engineered albumin binding polypeptide
LAEAKVLANRELDKYGKSDFYKNLINRAKTVEGVQSLKTEILAACP

SEQ ID NO: 491 - protein, 46 aa, ARTIFICIAL SEQUENCE
  Engineered albumin binding polypeptide
LAEAKVLANRELDKYGCSDFYKNLINRAKTVEGVQSLKTEILAACP

SEQ ID NO: 492 - protein, 46 aa, ARTIFICIAL SEQUENCE
  Engineered albumin binding polypeptide
LAEAKVLANRELDKYGKSDFYKNLINRAKTVEGVQSLKTEILAAKP

SEQ ID NO: 493 - protein, 46 aa, ARTIFICIAL SEQUENCE
  Engineered albumin binding polypeptide
LAEAKVLANRELDKYGCSDYYKNLINRAKTVEGVDALKTHILAAKP

SEQ ID NO: 494 - protein, 46 aa, ARTIFICIAL SEQUENCE
  Engineered albumin binding polypeptide
LAEAKVLANRELDKYGKSDYYKNLINRAKTVEGVDALKTHILAACP

SEQ ID NO: 495 - protein, 46 aa, ARTIFICIAL SEQUENCE
  Engineered albumin binding polypeptide
LAEAKVLANRELDKYGCSDYYKNLINRAKTVEGVDALKTHILAACP

SEQ ID NO: 496 - protein, 46 aa, ARTIFICIAL SEQUENCE
  Engineered albumin binding polypeptide
LAEAKVLANRELDKYGKSDYYKNLINRAKTVEGVDALKTHILAAKP

SEQ ID NO: 497 - protein, 46 aa, ARTIFICIAL SEQUENCE
  Engineered albumin binding polypeptide
LAEAKVLANRELDKYGCSDFYKSMINRAKTVEGVDSLKTHILAAKP

SEQ ID NO: 498 - protein, 46 aa, ARTIFICIAL SEQUENCE
  Engineered albumin binding polypeptide
LAEAKVLANRELDKYGKSDFYKSMINRAKTVEGVDSLKTHILAACP

SEQ ID NO: 499 - protein, 46 aa, ARTIFICIAL SEQUENCE
  Engineered albumin binding polypeptide
LAEAKVLANRELDKYGCSDFYKSMINRAKTVEGVDSLKTHILAACP

SEQ ID NO: 500 - protein, 46 aa, ARTIFICIAL SEQUENCE
  Engineered albumin binding polypeptide
LAEAKVLANRELDKYGKSDFYKSMINRAKTVEGVDSLKTHILAAKP

SEQ ID NO: 501 - protein, 46 aa, ARTIFICIAL SEQUENCE
  Engineered albumin binding polypeptide
LAEAKVLANRELDKYGCSDFYKNLINRAKTVEGVTTLKTDILAAKP

SEQ ID NO: 502 - protein, 46 aa, ARTIFICIAL SEQUENCE
  Engineered albumin binding polypeptide
LAEAKVLANRELDKYGKSDFYKNLINRAKTVEGVTTLKTDILAACP

SEQ ID NO: 503 - protein, 46 aa, ARTIFICIAL SEQUENCE
  Engineered albumin binding polypeptide
LAEAKVLANRELDKYGCSDFYKNLINRAKTVEGVTTLKTDILAACP

SEQ ID NO: 504 - protein, 46 aa, ARTIFICIAL SEQUENCE
  Engineered albumin binding polypeptide
LAEAKVLANRELDKYGKSDFYKNLINRAKTVEGVTTLKTDILAAKP

SEQ ID NO: 505 - protein, 46 aa, ARTIFICIAL SEQUENCE
  Engineered albumin binding polypeptide
LAEAKVLANRELDKYGCSDFYKNLINRAKTVEGVESLKDHILAAKP

SEQ ID NO: 506 - protein, 46 aa, ARTIFICIAL SEQUENCE
  Engineered albumin binding polypeptide
LAEAKVLANRELDKYGKSDFYKNLINRAKTVEGVESLKDHILAACP

SEQ ID NO: 507 - protein, 46 aa, ARTIFICIAL SEQUENCE
  Engineered albumin binding polypeptide
LAEAKVLANRELDKYGCSDFYKNLINRAKTVEGVESLKDHILAACP

SEQ ID NO: 508 - protein, 46 aa, ARTIFICIAL SEQUENCE
  Engineered albumin binding polypeptide
LAEAKVLANRELDKYGKSDFYKNLINRAKTVEGVESLKDHILAAKP

SEQ ID NO: 509 - protein, 46 aa, ARTIFICIAL SEQUENCE
  Engineered albumin binding polypeptide
LAEAKVLANRELDKYGCSDFYKSYINRAKTVEGVHTLKGHILAAKP

SEQ ID NO: 510 - protein, 46 aa, ARTIFICIAL SEQUENCE
  Engineered albumin binding polypeptide
LAEAKVLANRELDKYGKSDFYKSYINRAKTVEGVHTLKGHILAACP

SEQ ID NO: 511 - protein, 46 aa, ARTIFICIAL SEQUENCE
  Engineered albumin binding polypeptide
LAEAKVLANRELDKYGCSDFYKSYINRAKTVEGVHTLKGHILAACP

SEQ ID NO: 512 - protein, 46 aa, ARTIFICIAL SEQUENCE
  Engineered albumin binding polypeptide
LAEAKVLANRELDKYGKSDFYKSYINRAKTVEGVHTLKGHILAAKP

SEQ ID NO: 513 - protein, 46 aa, ARTIFICIAL SEQUENCE
  Engineered albumin binding polypeptide
LAEAKVLANRELDKYGCSDFYKNLINRAKTVEGVQTLKSDILAAKP

SEQ ID NO: 514 - protein, 46 aa, ARTIFICIAL SEQUENCE
  Engineered albumin binding polypeptide
LAEAKVLANRELDKYGKSDFYKNLINRAKTVEGVQTLKSDILAACP

SEQ ID NO: 515 - protein, 46 aa, ARTIFICIAL SEQUENCE
  Engineered albumin binding polypeptide
LAEAKVLANRELDKYGCSDFYKNLINRAKTVEGVQTLKSDILAACP

SEQ ID NO: 516 - protein, 46 aa, ARTIFICIAL SEQUENCE
  Engineered albumin binding polypeptide
LAEAKVLANRELDKYGKSDFYKNLINRAKTVEGVQTLKSDILAAKP

SEQ ID NO: 517 - protein, 46 aa, ARTIFICIAL SEQUENCE
  Engineered albumin binding polypeptide
LAEAKVLANRELDKYGCSDFYKNLINRAKTVEGVNSLKSHILAAKP

SEQ ID NO: 518 - protein, 46 aa, ARTIFICIAL SEQUENCE
  Engineered albumin binding polypeptide
LAEAKVLANRELDKYGKSDFYKNLINRAKTVEGVNSLKSHILAACP

SEQ ID NO: 519 - protein, 46 aa, ARTIFICIAL SEQUENCE
  Engineered albumin binding polypeptide
LAEAKVLANRELDKYGCSDFYKNLINRAKTVEGVNSLKSHILAACP

SEQ ID NO: 520 - protein, 46 aa, ARTIFICIAL SEQUENCE
  Engineered albumin binding polypeptide
LAEAKVLANRELDKYGKSDFYKNLINRAKTVEGVNSLKSHILAAKP

SEQ ID NO: 521 - protein, 46 aa, ARTIFICIAL SEQUENCE
  Engineered albumin binding polypeptide
LAEAKVLANRELDKYGCSDFYKNLINRAKTVEGVNTLKHDILAAKP

SEQ ID NO: 522 - protein, 46 aa, ARTIFICIAL SEQUENCE
  Engineered albumin binding polypeptide
LAEAKVLANRELDKYGKSDFYKNLINRAKTVEGVNTLKHDILAACP

SEQ ID NO: 523 - protein, 46 aa, ARTIFICIAL SEQUENCE
  Engineered albumin binding polypeptide
LAEAKVLANRELDKYGCSDFYKNLINRAKTVEGVNTLKHDILAACP

SEQ ID NO: 524 - protein, 46 aa, ARTIFICIAL SEQUENCE
  Engineered albumin binding polypeptide
LAEAKVLANRELDKYGKSDFYKNLINRAKTVEGVNTLKHDILAAKP

SEQ ID NO: 525 - protein, 46 aa, ARTIFICIAL SEQUENCE
  Engineered albumin binding polypeptide
LAEAKVLANRELDKYGCSDFYKNLINRAKTVEGVESLKGEILAAKP

SEQ ID NO: 526 - protein, 46 aa, ARTIFICIAL SEQUENCE
  Engineered albumin binding polypeptide
LAEAKVLANRELDKYGKSDFYKNLINRAKTVEGVESLKGEILAACP

SEQ ID NO: 527 - protein, 46 aa, ARTIFICIAL SEQUENCE
  Engineered albumin binding polypeptide
LAEAKVLANRELDKYGCSDFYKNLINRAKTVEGVESLKGEILAACP

SEQ ID NO: 528 - protein, 46 aa, ARTIFICIAL SEQUENCE
  Engineered albumin binding polypeptide
LAEAKVLANRELDKYGKSDFYKNLINRAKTVEGVESLKGEILAAKP

SEQ ID NO: 529 - protein, 46 aa, ARTIFICIAL SEQUENCE
  Engineered albumin binding polypeptide
LAEAKVLANRELDKYGCSDFYKNLINKAKTVEGVHTLKHDILAAKP

SEQ ID NO: 530 - protein, 46 aa, ARTIFICIAL SEQUENCE
  Engineered albumin binding polypeptide
LAEAKVLANRELDKYGKSDFYKNLINKAKTVEGVHTLKHDILAACP

SEQ ID NO: 531 - protein, 46 aa, ARTIFICIAL SEQUENCE
  Engineered albumin binding polypeptide
LAEAKVLANRELDKYGCSDFYKNLINKAKTVEGVHTLKHDILAACP

SEQ ID NO: 532 - protein, 46 aa, ARTIFICIAL SEQUENCE
  Engineered albumin binding polypeptide
LAEAKVLANRELDKYGKSDFYKNLINKAKTVEGVHTLKHDILAAKP

SEQ ID NO: 533 - protein, 46 aa, ARTIFICIAL SEQUENCE
  Engineered albumin binding polypeptide
LAEAKVLANRELDKYGCSDFYKNLINKAKTVEGVDALKVHILAAKP

SEQ ID NO: 534 - protein, 46 aa, ARTIFICIAL SEQUENCE
  Engineered albumin binding polypeptide
LAEAKVLANRELDKYGKSDFYKNLINKAKTVEGVDALKVHILAACP

SEQ ID NO: 535 - protein, 46 aa, ARTIFICIAL SEQUENCE
  Engineered albumin binding polypeptide
LAEAKVLANRELDKYGCSDFYKNLINKAKTVEGVDALKVHILAACP

SEQ ID NO: 536 - protein, 46 aa, ARTIFICIAL SEQUENCE
  Engineered albumin binding polypeptide
LAEAKVLANRELDKYGKSDFYKNLINKAKTVEGVDALKVHILAAKP

SEQ ID NO: 537 - protein, 46 aa, ARTIFICIAL SEQUENCE
  Engineered albumin binding polypeptide
LAEAKVLANRELDKYGCSDYYKRLINRAKTVEGVHALKAEILAAKP

SEQ ID NO: 538 - protein, 46 aa, ARTIFICIAL SEQUENCE
  Engineered albumin binding polypeptide
LAEAKVLANRELDKYGKSDYYKRLINRAKTVEGVHALKAEILAACP

SEQ ID NO: 539 - protein, 46 aa, ARTIFICIAL SEQUENCE
  Engineered albumin binding polypeptide
LAEAKVLANRELDKYGCSDYYKRLINRAKTVEGVHALKAEILAACP

SEQ ID NO: 540 - protein, 46 aa, ARTIFICIAL SEQUENCE
  Engineered albumin binding polypeptide
LAEAKVLANRELDKYGKSDYYKRLINRAKTVEGVHALKAEILAAKP

SEQ ID NO: 541 - protein, 46 aa, ARTIFICIAL SEQUENCE
  Engineered albumin binding polypeptide
LAEAKVLANRELDKYGCSDYYKNLINRARTVEGVDTLKHDILAAKP

SEQ ID NO: 542 - protein, 46 aa, ARTIFICIAL SEQUENCE
  Engineered albumin binding polypeptide
LAEAKVLANRELDKYGKSDYYKNLINRARTVEGVDTLKHDILAACP

SEQ ID NO: 543 - protein, 46 aa, ARTIFICIAL SEQUENCE
  Engineered albumin binding polypeptide
LAEAKVLANRELDKYGCSDYYKNLINRARTVEGVDTLKHDILAACP

SEQ ID NO: 544 - protein, 46 aa, ARTIFICIAL SEQUENCE
  Engineered albumin binding polypeptide
LAEAKVLANRELDKYGKSDYYKNLINRARTVEGVDTLKHDILAAKP

SEQ ID NO: 545 - protein, 46 aa, ARTIFICIAL SEQUENCE
  Engineered albumin binding polypeptide
LAEAKVLANRELDKYGCSDFYKKVINRARTVEGVQALKADILAAKP

SEQ ID NO: 546 - protein, 46 aa, ARTIFICIAL SEQUENCE
  Engineered albumin binding polypeptide
LAEAKVLANRELDKYGKSDFYKKVINRARTVEGVQALKADILAACP

SEQ ID NO: 547 - protein, 46 aa, ARTIFICIAL SEQUENCE
  Engineered albumin binding polypeptide
LAEAKVLANRELDKYGCSDFYKKVINRARTVEGVQALKADILAACP

SEQ ID NO: 548 - protein, 46 aa, ARTIFICIAL SEQUENCE
  Engineered albumin binding polypeptide
LAEAKVLANRELDKYGKSDFYKKVINRARTVEGVQALKADILAAKP

SEQ ID NO: 549 - protein, 46 aa, ARTIFICIAL SEQUENCE
  Engineered albumin binding polypeptide
LAEAKVLANRELDKYGCSDFYKNLINRAKTVEGVESLKADILAAKP

SEQ ID NO: 550 - protein, 46 aa, ARTIFICIAL SEQUENCE
  Engineered albumin binding polypeptide
LAEAKVLANRELDKYGKSDFYKNLINRAKTVEGVESLKADILAACP

SEQ ID NO: 551 - protein, 46 aa, ARTIFICIAL SEQUENCE
  Engineered albumin binding polypeptide
LAEAKVLANRELDKYGCSDFYKNLINRAKTVEGVESLKADILAACP

SEQ ID NO: 552 - protein, 46 aa, ARTIFICIAL SEQUENCE
  Engineered albumin binding polypeptide
LAEAKVLANRELDKYGKSDFYKNLINRAKTVEGVESLKADILAAKP

SEQ ID NO: 553 - protein, 46 aa, ARTIFICIAL SEQUENCE
  Engineered albumin binding polypeptide
LAEAKVLANRELDKYGCSDYYKNLINKAKTVEGVDALKAHILAAKP

SEQ ID NO: 554 - protein, 46 aa, ARTIFICIAL SEQUENCE
  Engineered albumin binding polypeptide
LAEAKVLANRELDKYGKSDYYKNLINKAKTVEGVDALKAHILAACP

SEQ ID NO: 555 - protein, 46 aa, ARTIFICIAL SEQUENCE
  Engineered albumin binding polypeptide
LAEAKVLANRELDKYGCSDYYKNLINKAKTVEGVDALKAHILAACP

SEQ ID NO: 556 - protein, 46 aa, ARTIFICIAL SEQUENCE
  Engineered albumin binding polypeptide
LAEAKVLANRELDKYGKSDYYKNLINKAKTVEGVDALKAHILAAKP

SEQ ID NO: 557 - protein, 46 aa, ARTIFICIAL SEQUENCE
  Engineered albumin binding polypeptide
LAEAKVLANRELDKYGCSDYYKNLINRAKTVEGVESLKTHILAAKP

SEQ ID NO: 558 - protein, 46 aa, ARTIFICIAL SEQUENCE
  Engineered albumin binding polypeptide
LAEAKVLANRELDKYGKSDYYKNLINRAKTVEGVESLKTHILAACP

SEQ ID NO: 559 - protein, 46 aa, ARTIFICIAL SEQUENCE
  Engineered albumin binding polypeptide
LAEAKVLANRELDKYGCSDYYKNLINRAKTVEGVESLKTHILAACP

SEQ ID NO: 560 - protein, 46 aa, ARTIFICIAL SEQUENCE
  Engineered albumin binding polypeptide
LAEAKVLANRELDKYGKSDYYKNLINRAKTVEGVESLKTHILAAKP

SEQ ID NO: 561 - protein, 46 aa, ARTIFICIAL SEQUENCE
  Engineered albumin binding polypeptide
LAEAKVLANRELDKYGCSDFYKNLINRARTVEGVDSLKVEILAAKP

SEQ ID NO: 562 - protein, 46 aa, ARTIFICIAL SEQUENCE
  Engineered albumin binding polypeptide
LAEAKVLANRELDKYGKSDFYKNLINRARTVEGVDSLKVEILAACP

SEQ ID NO: 563 - protein, 46 aa, ARTIFICIAL SEQUENCE
  Engineered albumin binding polypeptide
LAEAKVLANRELDKYGCSDFYKNLINRARTVEGVDSLKVEILAACP

SEQ ID NO: 564 - protein, 46 aa, ARTIFICIAL SEQUENCE
  Engineered albumin binding polypeptide
LAEAKVLANRELDKYGKSDFYKNLINRARTVEGVDSLKVEILAAKP

SEQ ID NO: 565 - protein, 46 aa, ARTIFICIAL SEQUENCE
  Engineered albumin binding polypeptide
LAEAKVLANRELDKYGCSDFYKNVINRAKTVEGVSALKREILAAKP

SEQ ID NO: 566 - protein, 46 aa, ARTIFICIAL SEQUENCE
  Engineered albumin binding polypeptide
LAEAKVLANRELDKYGKSDFYKNVINRAKTVEGVSALKREILAACP

SEQ ID NO: 567 - protein, 46 aa, ARTIFICIAL SEQUENCE
  Engineered albumin binding polypeptide
LAEAKVLANRELDKYGCSDFYKNVINRAKTVEGVSALKREILAACP

SEQ ID NO: 568 - protein, 46 aa, ARTIFICIAL SEQUENCE
  Engineered albumin binding polypeptide
LAEAKVLANRELDKYGKSDFYKNVINRAKTVEGVSALKREILAAKP

SEQ ID NO: 569 - protein, 46 aa, ARTIFICIAL SEQUENCE
  Engineered albumin binding polypeptide
LAEAKVLANRELDKYGCSDFYKNLINRAKTVEGVNALKSDILAAKP

SEQ ID NO: 570 - protein, 46 aa, ARTIFICIAL SEQUENCE
  Engineered albumin binding polypeptide
LAEAKVLANRELDKYGKSDFYKNLINRAKTVEGVNALKSDILAACP

SEQ ID NO: 571 - protein, 46 aa, ARTIFICIAL SEQUENCE
  Engineered albumin binding polypeptide
LAEAKVLANRELDKYGCSDFYKNLINRAKTVEGVNALKSDILAACP

SEQ ID NO: 572 - protein, 46 aa, ARTIFICIAL SEQUENCE
  Engineered albumin binding polypeptide
LAEAKVLANRELDKYGKSDFYKNLINRAKTVEGVNALKSDILAAKP

SEQ ID NO: 573 - protein, 46 aa, ARTIFICIAL SEQUENCE
  Engineered albumin binding polypeptide
LAEAKVLANRELDKYGCSDFYKNLINRAKTVEGVSALKQEILAAKP

SEQ ID NO: 574 - protein, 46 aa, ARTIFICIAL SEQUENCE
  Engineered albumin binding polypeptide
LAEAKVLANRELDKYGKSDFYKNLINRAKTVEGVSALKQEILAACP

SEQ ID NO: 575 - protein, 46 aa, ARTIFICIAL SEQUENCE
  Engineered albumin binding polypeptide
LAEAKVLANRELDKYGCSDFYKNLINRAKTVEGVSALKQEILAACP

SEQ ID NO: 576 - protein, 46 aa, ARTIFICIAL SEQUENCE
  Engineered albumin binding polypeptide
LAEAKVLANRELDKYGKSDFYKNLINRAKTVEGVSALKQEILAAKP

SEQ ID NO: 577 - protein, 46 aa, ARTIFICIAL SEQUENCE
  Engineered albumin binding polypeptide
LAEAKVLANRELDKYGCSDFYKNLINRAKTVEGVQSLKDHILAAKP

SEQ ID NO: 578 - protein, 46 aa, ARTIFICIAL SEQUENCE
  Engineered albumin binding polypeptide
LAEAKVLANRELDKYGKSDFYKNLINRAKTVEGVQSLKDHILAACP

SEQ ID NO: 579 - protein, 46 aa, ARTIFICIAL SEQUENCE
  Engineered albumin binding polypeptide
LAEAKVLANRELDKYGCSDFYKNLINRAKTVEGVQSLKDHILAACP

SEQ ID NO: 580 - protein, 46 aa, ARTIFICIAL SEQUENCE
  Engineered albumin binding polypeptide
LAEAKVLANRELDKYGKSDFYKNLINRAKTVEGVQSLKDHILAAKP

SEQ ID NO: 581 - protein, 46 aa, ARTIFICIAL SEQUENCE
  Engineered albumin binding polypeptide
LAEAKVLANRELDKYGCSDFYKNLINRAKTVEGVDALKCHILAAKP

SEQ ID NO: 582 - protein, 46 aa, ARTIFICIAL SEQUENCE
  Engineered albumin binding polypeptide
LAEAKVLANRELDKYGKSDFYKNLINRAKTVEGVDALKCHILAACP

SEQ ID NO: 583 - protein, 46 aa, ARTIFICIAL SEQUENCE
  Engineered albumin binding polypeptide
LAEAKVLANRELDKYGCSDFYKNLINRAKTVEGVDALKCHILAACP

SEQ ID NO: 584 - protein, 46 aa, ARTIFICIAL SEQUENCE
  Engineered albumin binding polypeptide
LAEAKVLANRELDKYGKSDFYKNLINRAKTVEGVDALKCHILAAKP

SEQ ID NO: 585 - protein, 46 aa, ARTIFICIAL SEQUENCE
  Engineered albumin binding polypeptide
LAEAKVLANRELDKYGCSDYYKRLINKAKTVEGVNALKTHILAAKP

SEQ ID NO: 586 - protein, 46 aa, ARTIFICIAL SEQUENCE
  Engineered albumin binding polypeptide
LAEAKVLANRELDKYGKSDYYKRLINKAKTVEGVNALKTHILAACP

SEQ ID NO: 587 - protein, 46 aa, ARTIFICIAL SEQUENCE
  Engineered albumin binding polypeptide
LAEAKVLANRELDKYGCSDYYKRLINKAKTVEGVNALKTHILAACP

SEQ ID NO: 588 - protein, 46 aa, ARTIFICIAL SEQUENCE
  Engineered albumin binding polypeptide
LAEAKVLANRELDKYGKSDYYKRLINKAKTVEGVNALKTHILAAKP

SEQ ID NO: 589 - protein, 46 aa, ARTIFICIAL SEQUENCE
  Engineered albumin binding polypeptide
LAEAKVLANRELDKYGCSDFYKNVINKAKTVEGVEALKADILAAKP

SEQ ID NO: 590 - protein, 46 aa, ARTIFICIAL SEQUENCE
  Engineered albumin binding polypeptide
LAEAKVLANRELDKYGKSDFYKNVINKAKTVEGVEALKADILAACP

SEQ ID NO: 591 - protein, 46 aa, ARTIFICIAL SEQUENCE
  Engineered albumin binding polypeptide
LAEAKVLANRELDKYGCSDFYKNVINKAKTVEGVEALKADILAACP

SEQ ID NO: 592 - protein, 46 aa, ARTIFICIAL SEQUENCE
  Engineered albumin binding polypeptide
LAEAKVLANRELDKYGKSDFYKNVINKAKTVEGVEALKADILAAKP

SEQ ID NO: 593 - protein, 46 aa, ARTIFICIAL SEQUENCE
  Engineered albumin binding polypeptide
LAEAKVLANRELDKYGCSDFYKNLINRAKTVEGVETLKRDILAAKP

SEQ ID NO: 594 - protein, 46 aa, ARTIFICIAL SEQUENCE
  Engineered albumin binding polypeptide
LAEAKVLANRELDKYGKSDFYKNLINRAKTVEGVETLKRDILAACP

SEQ ID NO: 595 - protein, 46 aa, ARTIFICIAL SEQUENCE
  Engineered albumin binding polypeptide
LAEAKVLANRELDKYGCSDFYKNLINRAKTVEGVETLKRDILAACP

SEQ ID NO: 596 - protein, 46 aa, ARTIFICIAL SEQUENCE
  Engineered albumin binding polypeptide
LAEAKVLANRELDKYGKSDFYKNLINRAKTVEGVETLKRDILAAKP

SEQ ID NO: 597 - protein, 46 aa, ARTIFICIAL SEQUENCE
  Engineered albumin binding polypeptide
LAEAKVLANRELDKYGCSDFYKNLINRARTVEGVQTLKTDILAAKP

SEQ ID NO: 598 - protein, 46 aa, ARTIFICIAL SEQUENCE
  Engineered albumin binding polypeptide
LAEAKVLANRELDKYGKSDFYKNLINRARTVEGVQTLKTDILAACP

SEQ ID NO: 599 - protein, 46 aa, ARTIFICIAL SEQUENCE
  Engineered albumin binding polypeptide
LAEAKVLANRELDKYGCSDFYKNLINRARTVEGVQTLKTDILAACP

SEQ ID NO: 600 - protein, 46 aa, ARTIFICIAL SEQUENCE
  Engineered albumin binding polypeptide
LAEAKVLANRELDKYGKSDFYKNLINRARTVEGVQTLKTDILAAKP

SEQ ID NO: 601 - protein, 46 aa, ARTIFICIAL SEQUENCE
  Engineered albumin binding polypeptide
LAEAKVLANRELDKYGCSDFYKRLINKAKTVEGVNALKHHILAAKP

SEQ ID NO: 602 - protein, 46 aa, ARTIFICIAL SEQUENCE
  Engineered albumin binding polypeptide
LAEAKVLANRELDKYGKSDFYKRLINKAKTVEGVNALKHHILAACP

SEQ ID NO: 603 - protein, 46 aa, ARTIFICIAL SEQUENCE
  Engineered albumin binding polypeptide
LAEAKVLANRELDKYGCSDFYKRLINKAKTVEGVNALKHHILAACP

SEQ ID NO: 604 - protein, 46 aa, ARTIFICIAL SEQUENCE
  Engineered albumin binding polypeptide
LAEAKVLANRELDKYGKSDFYKRLINKAKTVEGVNALKHHILAAKP

SEQ ID NO: 605 - protein, 46 aa, ARTIFICIAL SEQUENCE
  Engineered albumin binding polypeptide
LAEAKVLANRELDKYGCSDYYKNLINRAKTVEGVQALKAHILAAKP

SEQ ID NO: 606 - protein, 46 aa, ARTIFICIAL SEQUENCE
  Engineered albumin binding polypeptide
LAEAKVLANRELDKYGKSDYYKNLINRAKTVEGVQALKAHILAACP

SEQ ID NO: 607 - protein, 46 aa, ARTIFICIAL SEQUENCE
  Engineered albumin binding polypeptide
LAEAKVLANRELDKYGCSDYYKNLINRAKTVEGVQALKAHILAACP

SEQ ID NO: 608 - protein, 46 aa, ARTIFICIAL SEQUENCE
  Engineered albumin binding polypeptide
LAEAKVLANRELDKYGKSDYYKNLINRAKTVEGVQALKAHILAAKP

SEQ ID NO: 609 - protein, 46 aa, ARTIFICIAL SEQUENCE
  Engineered albumin binding polypeptide
LAEAKVLANRELDKYGCSDFYKNVINRAKTVEGVNSLKNHILAAKP

SEQ ID NO: 610 - protein, 46 aa, ARTIFICIAL SEQUENCE
  Engineered albumin binding polypeptide
LAEAKVLANRELDKYGKSDFYKNVINRAKTVEGVNSLKNHILAACP

SEQ ID NO: 611 - protein, 46 aa, ARTIFICIAL SEQUENCE
  Engineered albumin binding polypeptide
LAEAKVLANRELDKYGCSDFYKNVINRAKTVEGVNSLKNHILAACP

SEQ ID NO: 612 - protein, 46 aa, ARTIFICIAL SEQUENCE
  Engineered albumin binding polypeptide
LAEAKVLANRELDKYGKSDFYKNVINRAKTVEGVNSLKNHILAAKP

SEQ ID NO: 613 - protein, 46 aa, ARTIFICIAL SEQUENCE
  Engineered albumin binding polypeptide
LAEAKVLANRELDKYGCSDFYKSLINRARTVEGVDSLKRHILAAKP

SEQ ID NO: 614 - protein, 46 aa, ARTIFICIAL SEQUENCE
  Engineered albumin binding polypeptide
LAEAKVLANRELDKYGKSDFYKSLINRARTVEGVDSLKRHILAACP

SEQ ID NO: 615 - protein, 46 aa, ARTIFICIAL SEQUENCE
  Engineered albumin binding polypeptide
LAEAKVLANRELDKYGCSDFYKSLINRARTVEGVDSLKRHILAACP

SEQ ID NO: 616 - protein, 46 aa, ARTIFICIAL SEQUENCE
  Engineered albumin binding polypeptide
LAEAKVLANRELDKYGKSDFYKSLINRARTVEGVDSLKRHILAAKP

SEQ ID NO: 617 - protein, 46 aa, ARTIFICIAL SEQUENCE
  Engineered albumin binding polypeptide
LAEAKVLANRELDKYGCSDYYKNLINKAKTVEGVEALKLHILAAKP

SEQ ID NO: 618 - protein, 46 aa, ARTIFICIAL SEQUENCE
  Engineered albumin binding polypeptide
LAEAKVLANRELDKYGKSDYYKNLINKAKTVEGVEALKLHILAACP

SEQ ID NO: 619 - protein, 46 aa, ARTIFICIAL SEQUENCE
  Engineered albumin binding polypeptide
LAEAKVLANRELDKYGCSDYYKNLINKAKTVEGVEALKLHILAACP

SEQ ID NO: 620 - protein, 46 aa, ARTIFICIAL SEQUENCE
  Engineered albumin binding polypeptide
LAEAKVLANRELDKYGKSDYYKNLINKAKTVEGVEALKLHILAAKP

SEQ ID NO: 621 - protein, 46 aa, ARTIFICIAL SEQUENCE
  Engineered albumin binding polypeptide
LAEAKVLANRELDKYGCSDFYKNLINRAKTVEGVDALKAHILAAKP

SEQ ID NO: 622 - protein, 46 aa, ARTIFICIAL SEQUENCE
  Engineered albumin binding polypeptide
LAEAKVLANRELDKYGKSDFYKNLINRAKTVEGVDALKAHILAACP

SEQ ID NO: 623 - protein, 46 aa, ARTIFICIAL SEQUENCE
  Engineered albumin binding polypeptide
LAEAKVLANRELDKYGCSDFYKNLINRAKTVEGVDALKAHILAACP

SEQ ID NO: 624 - protein, 46 aa, ARTIFICIAL SEQUENCE
  Engineered albumin binding polypeptide
LAEAKVLANRELDKYGKSDFYKNLINRAKTVEGVDALKAHILAAKP

SEQ ID NO: 625 - protein, 46 aa, ARTIFICIAL SEQUENCE
  Engineered albumin binding polypeptide
LAEAKVLANRELDKYGCSDYYKNLINKAKTVEGVQALKAHILAAKP

SEQ ID NO: 626 - protein, 46 aa, ARTIFICIAL SEQUENCE
  Engineered albumin binding polypeptide
LAEAKVLANRELDKYGKSDYYKNLINKAKTVEGVQALKAHILAACP

SEQ ID NO: 627 - protein, 46 aa, ARTIFICIAL SEQUENCE
  Engineered albumin binding polypeptide
LAEAKVLANRELDKYGCSDYYKNLINKAKTVEGVQALKAHILAACP

SEQ ID NO: 628 - protein, 46 aa, ARTIFICIAL SEQUENCE
  Engineered albumin binding polypeptide
LAEAKVLANRELDKYGKSDYYKNLINKAKTVEGVQALKAHILAAKP

SEQ ID NO: 629 - protein, 46 aa, ARTIFICIAL SEQUENCE
  Engineered albumin binding polypeptide
LAEAKVLANRELDKYGCSDFYKRLINRAKTVEGVHALKGHILAAKP

SEQ ID NO: 630 - protein, 46 aa, ARTIFICIAL SEQUENCE
  Engineered albumin binding polypeptide
LAEAKVLANRELDKYGKSDFYKRLINRAKTVEGVHALKGHILAACP

SEQ ID NO: 631 - protein, 46 aa, ARTIFICIAL SEQUENCE
  Engineered albumin binding polypeptide
LAEAKVLANRELDKYGCSDFYKRLINRAKTVEGVHALKGHILAACP

SEQ ID NO: 632 - protein, 46 aa, ARTIFICIAL SEQUENCE
  Engineered albumin binding polypeptide
LAEAKVLANRELDKYGKSDFYKRLINRAKTVEGVHALKGHILAAKP

SEQ ID NO: 633 - protein, 46 aa, ARTIFICIAL SEQUENCE
  Engineered albumin binding polypeptide
LAEAKVLANRELDKYGCSDFYKRVINRAKTVEGVHALKDHILAAKP

SEQ ID NO: 634 - protein, 46 aa, ARTIFICIAL SEQUENCE
  Engineered albumin binding polypeptide
LAEAKVLANRELDKYGKSDFYKRVINRAKTVEGVHALKDHILAACP

SEQ ID NO: 635 - protein, 46 aa, ARTIFICIAL SEQUENCE
  Engineered albumin binding polypeptide
LAEAKVLANRELDKYGCSDFYKRVINRAKTVEGVHALKDHILAACP

SEQ ID NO: 636 - protein, 46 aa, ARTIFICIAL SEQUENCE
  Engineered albumin binding polypeptide
LAEAKVLANRELDKYGKSDFYKRVINRAKTVEGVHALKDHILAAKP

SEQ ID NO: 637 - protein, 46 aa, ARTIFICIAL SEQUENCE
  Engineered albumin binding polypeptide
LAEAKVLANRELDKYGCSDFYKRVINRAKTVEGVSALKHEILAAKP

SEQ ID NO: 638 - protein, 46 aa, ARTIFICIAL SEQUENCE
  Engineered albumin binding polypeptide
LAEAKVLANRELDKYGKSDFYKRVINRAKTVEGVSALKHEILAACP

SEQ ID NO: 639 - protein, 46 aa, ARTIFICIAL SEQUENCE
  Engineered albumin binding polypeptide
LAEAKVLANRELDKYGCSDFYKRVINRAKTVEGVSALKHEILAACP

SEQ ID NO: 640 - protein, 46 aa, ARTIFICIAL SEQUENCE
  Engineered albumin binding polypeptide
LAEAKVLANRELDKYGKSDFYKRVINRAKTVEGVSALKHEILAAKP

SEQ ID NO: 641 - protein, 46 aa, ARTIFICIAL SEQUENCE
  Engineered albumin binding polypeptide
LAEAKVLANRELDKYGCSDYYKRLINRAKTVEGVNSLKSHILAAKP

SEQ ID NO: 642 - protein, 46 aa, ARTIFICIAL SEQUENCE
  Engineered albumin binding polypeptide
LAEAKVLANRELDKYGKSDYYKRLINRAKTVEGVNSLKSHILAACP

SEQ ID NO: 643 - protein, 46 aa, ARTIFICIAL SEQUENCE
  Engineered albumin binding polypeptide
LAEAKVLANRELDKYGCSDYYKRLINRAKTVEGVNSLKSHILAACP

SEQ ID NO: 644 - protein, 46 aa, ARTIFICIAL SEQUENCE
  Engineered albumin binding polypeptide
LAEAKVLANRELDKYGKSDYYKRLINRAKTVEGVNSLKSHILAAKP

SEQ ID NO: 645 - protein, 46 aa, ARTIFICIAL SEQUENCE
  Engineered albumin binding polypeptide
LAEAKVLANRELDKYGCSDFYKRVINRAKTVEGVDSLKAEILAAKP

SEQ ID NO: 646 - protein, 46 aa, ARTIFICIAL SEQUENCE
  Engineered albumin binding polypeptide
LAEAKVLANRELDKYGKSDFYKRVINRAKTVEGVDSLKAEILAACP

SEQ ID NO: 647 - protein, 46 aa, ARTIFICIAL SEQUENCE
  Engineered albumin binding polypeptide
LAEAKVLANRELDKYGCSDFYKRVINRAKTVEGVDSLKAEILAACP

SEQ ID NO: 648 - protein, 46 aa, ARTIFICIAL SEQUENCE
  Engineered albumin binding polypeptide
LAEAKVLANRELDKYGKSDFYKRVINRAKTVEGVDSLKAEILAAKP

SEQ ID NO: 649 - protein, 46 aa, ARTIFICIAL SEQUENCE
  Engineered albumin binding polypeptide
LAEAKVLANRELDKYGCSDFYKRLINRARTVEGVQTLKSDILAAKP

SEQ ID NO: 650 - protein, 46 aa, ARTIFICIAL SEQUENCE
  Engineered albumin binding polypeptide
LAEAKVLANRELDKYGKSDFYKRLINRARTVEGVQTLKSDILAACP

SEQ ID NO: 651 - protein, 46 aa, ARTIFICIAL SEQUENCE
  Engineered albumin binding polypeptide
LAEAKVLANRELDKYGCSDFYKRLINRARTVEGVQTLKSDILAACP

SEQ ID NO: 652 - protein, 46 aa, ARTIFICIAL SEQUENCE
  Engineered albumin binding polypeptide
LAEAKVLANRELDKYGKSDFYKRLINRARTVEGVQTLKSDILAAKP

SEQ ID NO: 653 - protein, 46 aa, ARTIFICIAL SEQUENCE
  Engineered albumin binding polypeptide
LAEAKVLANRELDKYGCSDFYKRFINKAKTVEGVETLKSEILAAKP

SEQ ID NO: 654 - protein, 46 aa, ARTIFICIAL SEQUENCE
  Engineered albumin binding polypeptide
LAEAKVLANRELDKYGKSDFYKRFINKAKTVEGVETLKSEILAACP

SEQ ID NO: 655 - protein, 46 aa, ARTIFICIAL SEQUENCE
  Engineered albumin binding polypeptide
LAEAKVLANRELDKYGCSDFYKRFINKAKTVEGVETLKSEILAACP

SEQ ID NO: 656 - protein, 46 aa, ARTIFICIAL SEQUENCE
  Engineered albumin binding polypeptide
LAEAKVLANRELDKYGKSDFYKRFINKAKTVEGVETLKSEILAAKP

SEQ ID NO: 657 - protein, 46 aa, ARTIFICIAL SEQUENCE
  Engineered albumin binding polypeptide
LAEAKVLANRELDKYGCSDFYKRLINRAKTVEGVHSLKDEILAAKP

SEQ ID NO: 658 - protein, 46 aa, ARTIFICIAL SEQUENCE
  Engineered albumin binding polypeptide
LAEAKVLANRELDKYGKSDFYKRLINRAKTVEGVHSLKDEILAACP

SEQ ID NO: 659 - protein, 46 aa, ARTIFICIAL SEQUENCE
  Engineered albumin binding polypeptide
LAEAKVLANRELDKYGCSDFYKRLINRAKTVEGVHSLKDEILAACP

SEQ ID NO: 660 - protein, 46 aa, ARTIFICIAL SEQUENCE
  Engineered albumin binding polypeptide
LAEAKVLANRELDKYGKSDFYKRLINRAKTVEGVHSLKDEILAAKP

SEQ ID NO: 661 - protein, 46 aa, ARTIFICIAL SEQUENCE
  Engineered albumin binding polypeptide
LAEAKVLANRELDKYGCSDYYKRVINKAKTVEGVSSLKAEILAAKP

SEQ ID NO: 662 - protein, 46 aa, ARTIFICIAL SEQUENCE
  Engineered albumin binding polypeptide
LAEAKVLANRELDKYGKSDYYKRVINKAKTVEGVSSLKAEILAACP

SEQ ID NO: 663 - protein, 46 aa, ARTIFICIAL SEQUENCE
  Engineered albumin binding polypeptide
LAEAKVLANRELDKYGCSDYYKRVINKAKTVEGVSSLKAEILAACP

SEQ ID NO: 664 - protein, 46 aa, ARTIFICIAL SEQUENCE
  Engineered albumin binding polypeptide
LAEAKVLANRELDKYGKSDYYKRVINKAKTVEGVSSLKAEILAAKP

SEQ ID NO: 665 - protein, 46 aa, ARTIFICIAL SEQUENCE
  Engineered albumin binding polypeptide
LAEAKVLANRELDKYGCSDFYKRLINRAKTVEGVDALKSHILAAKP

SEQ ID NO: 666 - protein, 46 aa, ARTIFICIAL SEQUENCE
  Engineered albumin binding polypeptide
LAEAKVLANRELDKYGKSDFYKRLINRAKTVEGVDALKSHILAACP

SEQ ID NO: 667 - protein, 46 aa, ARTIFICIAL SEQUENCE
  Engineered albumin binding polypeptide
LAEAKVLANRELDKYGCSDFYKRLINRAKTVEGVDALKSHILAACP

SEQ ID NO: 668 - protein, 46 aa, ARTIFICIAL SEQUENCE
  Engineered albumin binding polypeptide
LAEAKVLANRELDKYGKSDFYKRLINRAKTVEGVDALKSHILAAKP

SEQ ID NO: 669 - protein, 46 aa, ARTIFICIAL SEQUENCE
  Engineered albumin binding polypeptide
LAEAKVLANRELDKYGCSDFYKRLINKAKTVEGVSTLKHDILAAKP

SEQ ID NO: 670 - protein, 46 aa, ARTIFICIAL SEQUENCE
  Engineered albumin binding polypeptide
LAEAKVLANRELDKYGKSDFYKRLINKAKTVEGVSTLKHDILAACP

SEQ ID NO: 671 - protein, 46 aa, ARTIFICIAL SEQUENCE
  Engineered albumin binding polypeptide
LAEAKVLANRELDKYGCSDFYKRLINKAKTVEGVSTLKHDILAACP

SEQ ID NO: 672 - protein, 46 aa, ARTIFICIAL SEQUENCE
  Engineered albumin binding polypeptide
LAEAKVLANRELDKYGKSDFYKRLINKAKTVEGVSTLKHDILAAKP

SEQ ID NO: 673 - protein, 46 aa, ARTIFICIAL SEQUENCE
  Engineered albumin binding polypeptide
LAEAKVLANRELDKYGCSDFYKRLINRAKTVEGVSTLKHDILAAKP

SEQ ID NO: 674 - protein, 46 aa, ARTIFICIAL SEQUENCE
  Engineered albumin binding polypeptide
LAEAKVLANRELDKYGKSDFYKRLINRAKTVEGVSTLKHDILAACP

SEQ ID NO: 675 - protein, 46 aa, ARTIFICIAL SEQUENCE
  Engineered albumin binding polypeptide
LAEAKVLANRELDKYGCSDFYKRLINRAKTVEGVSTLKHDILAACP

SEQ ID NO: 676 - protein, 46 aa, ARTIFICIAL SEQUENCE
  Engineered albumin binding polypeptide
LAEAKVLANRELDKYGKSDFYKRLINRAKTVEGVSTLKHDILAAKP

SEQ ID NO: 677 - protein, 46 aa, ARTIFICIAL SEQUENCE
  Engineered albumin binding polypeptide
LAEAKVLANRELDKYGCSDFYKRLINRAKTVEGVQALKSEILAAKP

SEQ ID NO: 678 - protein, 46 aa, ARTIFICIAL SEQUENCE
  Engineered albumin binding polypeptide
LAEAKVLANRELDKYGKSDFYKRLINRAKTVEGVQALKSEILAACP

SEQ ID NO: 679 - protein, 46 aa, ARTIFICIAL SEQUENCE
  Engineered albumin binding polypeptide
LAEAKVLANRELDKYGCSDFYKRLINRAKTVEGVQALKSEILAACP

SEQ ID NO: 680 - protein, 46 aa, ARTIFICIAL SEQUENCE
  Engineered albumin binding polypeptide
LAEAKVLANRELDKYGKSDFYKRLINRAKTVEGVQALKSEILAAKP

SEQ ID NO: 681 - protein, 46 aa, ARTIFICIAL SEQUENCE
  Engineered albumin binding polypeptide
LAEAKVLANRELDKYGCSDYYKRLINKAKTVEGVDSLKVHILAAKP

SEQ ID NO: 682 - protein, 46 aa, ARTIFICIAL SEQUENCE
  Engineered albumin binding polypeptide
LAEAKVLANRELDKYGKSDYYKRLINKAKTVEGVDSLKVHILAACP

SEQ ID NO: 683 - protein, 46 aa, ARTIFICIAL SEQUENCE
  Engineered albumin binding polypeptide
LAEAKVLANRELDKYGCSDYYKRLINKAKTVEGVDSLKVHILAACP

SEQ ID NO: 684 - protein, 46 aa, ARTIFICIAL SEQUENCE
  Engineered albumin binding polypeptide
LAEAKVLANRELDKYGKSDYYKRLINKAKTVEGVDSLKVHILAAKP

SEQ ID NO: 685 - protein, 46 aa, ARTIFICIAL SEQUENCE
  Engineered albumin binding polypeptide
LAEAKVLANRELDKYGCSDFYKRLINRAKTVEGVQSLKTEILAAKP

SEQ ID NO: 686 - protein, 46 aa, ARTIFICIAL SEQUENCE
  Engineered albumin binding polypeptide
LAEAKVLANRELDKYGKSDFYKRLINRAKTVEGVQSLKTEILAACP

SEQ ID NO: 687 - protein, 46 aa, ARTIFICIAL SEQUENCE
  Engineered albumin binding polypeptide
LAEAKVLANRELDKYGCSDFYKRLINRAKTVEGVQSLKTEILAACP

SEQ ID NO: 688 - protein, 46 aa, ARTIFICIAL SEQUENCE
  Engineered albumin binding polypeptide
LAEAKVLANRELDKYGKSDFYKRLINRAKTVEGVQSLKTEILAAKP

SEQ ID NO: 689 - protein, 46 aa, ARTIFICIAL SEQUENCE
  Engineered albumin binding polypeptide
LAEAKVLANRELDKYGCSDYYKRLINRAKTVEGVDALKTHILAAKP

SEQ ID NO: 690 - protein, 46 aa, ARTIFICIAL SEQUENCE
  Engineered albumin binding polypeptide
LAEAKVLANRELDKYGKSDYYKRLINRAKTVEGVDALKTHILAACP

SEQ ID NO: 691 - protein, 46 aa, ARTIFICIAL SEQUENCE
  Engineered albumin binding polypeptide
LAEAKVLANRELDKYGCSDYYKRLINRAKTVEGVDALKTHILAACP

SEQ ID NO: 692 - protein, 46 aa, ARTIFICIAL SEQUENCE
  Engineered albumin binding polypeptide
LAEAKVLANRELDKYGKSDYYKRLINRAKTVEGVDALKTHILAAKP

SEQ ID NO: 693 - protein, 46 aa, ARTIFICIAL SEQUENCE
  Engineered albumin binding polypeptide
LAEAKVLANRELDKYGCSDFYKRMINRAKTVEGVDSLKTHILAAKP

SEQ ID NO: 694 - protein, 46 aa, ARTIFICIAL SEQUENCE
  Engineered albumin binding polypeptide
LAEAKVLANRELDKYGKSDFYKRMINRAKTVEGVDSLKTHILAACP

SEQ ID NO: 695 - protein, 46 aa, ARTIFICIAL SEQUENCE
  Engineered albumin binding polypeptide
LAEAKVLANRELDKYGCSDFYKRMINRAKTVEGVDSLKTHILAACP

SEQ ID NO: 696 - protein, 46 aa, ARTIFICIAL SEQUENCE
  Engineered albumin binding polypeptide
LAEAKVLANRELDKYGKSDFYKRMINRAKTVEGVDSLKTHILAAKP

SEQ ID NO: 697 - protein, 46 aa, ARTIFICIAL SEQUENCE
  Engineered albumin binding polypeptide
LAEAKVLANRELDKYGCSDFYKRLINRAKTVEGVTTLKTDILAAKP

SEQ ID NO: 698 - protein, 46 aa, ARTIFICIAL SEQUENCE
  Engineered albumin binding polypeptide
LAEAKVLANRELDKYGKSDFYKRLINRAKTVEGVTTLKTDILAACP

SEQ ID NO: 699 - protein, 46 aa, ARTIFICIAL SEQUENCE
  Engineered albumin binding polypeptide
LAEAKVLANRELDKYGCSDFYKRLINRAKTVEGVTTLKTDILAACP

SEQ ID NO: 700 - protein, 46 aa, ARTIFICIAL SEQUENCE
  Engineered albumin binding polypeptide
LAEAKVLANRELDKYGKSDFYKRLINRAKTVEGVTTLKTDILAAKP

SEQ ID NO: 701 - protein, 46 aa, ARTIFICIAL SEQUENCE
  Engineered albumin binding polypeptide
LAEAKVLANRELDKYGCSDFYKRLINRAKTVEGVESLKDHILAAKP

SEQ ID NO: 702 - protein, 46 aa, ARTIFICIAL SEQUENCE
  Engineered albumin binding polypeptide
LAEAKVLANRELDKYGKSDFYKRLINRAKTVEGVESLKDHILAACP

SEQ ID NO: 703 - protein, 46 aa, ARTIFICIAL SEQUENCE
  Engineered albumin binding polypeptide
LAEAKVLANRELDKYGCSDFYKRLINRAKTVEGVESLKDHILAACP

SEQ ID NO: 704 - protein, 46 aa, ARTIFICIAL SEQUENCE
  Engineered albumin binding polypeptide
LAEAKVLANRELDKYGKSDFYKRLINRAKTVEGVESLKDHILAAKP

SEQ ID NO: 705 - protein, 46 aa, ARTIFICIAL SEQUENCE
  Engineered albumin binding polypeptide
LAEAKVLANRELDKYGCSDFYKRYINRAKTVEGVHTLKGHILAAKP

SEQ ID NO: 706 - protein, 46 aa, ARTIFICIAL SEQUENCE
  Engineered albumin binding polypeptide
LAEAKVLANRELDKYGKSDFYKRYINRAKTVEGVHTLKGHILAACP

SEQ ID NO: 707 - protein, 46 aa, ARTIFICIAL SEQUENCE
  Engineered albumin binding polypeptide
LAEAKVLANRELDKYGCSDFYKRYINRAKTVEGVHTLKGHILAACP

SEQ ID NO: 708 - protein, 46 aa, ARTIFICIAL SEQUENCE
  Engineered albumin binding polypeptide
LAEAKVLANRELDKYGKSDFYKRYINRAKTVEGVHTLKGHILAAKP

SEQ ID NO: 709 - protein, 46 aa, ARTIFICIAL SEQUENCE
  Engineered albumin binding polypeptide
LAEAKVLANRELDKYGCSDFYKRLINRAKTVEGVQTLKSDILAAKP

SEQ ID NO: 710 - protein, 46 aa, ARTIFICIAL SEQUENCE
  Engineered albumin binding polypeptide
LAEAKVLANRELDKYGKSDFYKRLINRAKTVEGVQTLKSDILAACP

SEQ ID NO: 711 - protein, 46 aa, ARTIFICIAL SEQUENCE
  Engineered albumin binding polypeptide
LAEAKVLANRELDKYGCSDFYKRLINRAKTVEGVQTLKSDILAACP

SEQ ID NO: 712 - protein, 46 aa, ARTIFICIAL SEQUENCE
  Engineered albumin binding polypeptide
LAEAKVLANRELDKYGKSDFYKRLINRAKTVEGVQTLKSDILAAKP

SEQ ID NO: 713 - protein, 46 aa, ARTIFICIAL SEQUENCE
  Engineered albumin binding polypeptide
LAEAKVLANRELDKYGCSDFYKRLINRAKTVEGVNSLKSHILAAKP

SEQ ID NO: 714 - protein, 46 aa, ARTIFICIAL SEQUENCE
  Engineered albumin binding polypeptide
LAEAKVLANRELDKYGKSDFYKRLINRAKTVEGVNSLKSHILAACP

SEQ ID NO: 715 - protein, 46 aa, ARTIFICIAL SEQUENCE
  Engineered albumin binding polypeptide
LAEAKVLANRELDKYGCSDFYKRLINRAKTVEGVNSLKSHILAACP

SEQ ID NO: 716 - protein, 46 aa, ARTIFICIAL SEQUENCE
  Engineered albumin binding polypeptide
LAEAKVLANRELDKYGKSDFYKRLINRAKTVEGVNSLKSHILAAKP

SEQ ID NO: 717 - protein, 46 aa, ARTIFICIAL SEQUENCE
  Engineered albumin binding polypeptide
LAEAKVLANRELDKYGCSDFYKRLINRAKTVEGVNTLKHDILAAKP

SEQ ID NO: 718 - protein, 46 aa, ARTIFICIAL SEQUENCE
  Engineered albumin binding polypeptide
LAEAKVLANRELDKYGKSDFYKRLINRAKTVEGVNTLKHDILAACP

SEQ ID NO: 719 - protein, 46 aa, ARTIFICIAL SEQUENCE
  Engineered albumin binding polypeptide
LAEAKVLANRELDKYGCSDFYKRLINRAKTVEGVNTLKHDILAACP

SEQ ID NO: 720 - protein, 46 aa, ARTIFICIAL SEQUENCE
  Engineered albumin binding polypeptide
LAEAKVLANRELDKYGKSDFYKRLINRAKTVEGVNTLKHDILAAKP

SEQ ID NO: 721 - protein, 46 aa, ARTIFICIAL SEQUENCE
  Engineered albumin binding polypeptide
LAEAKVLANRELDKYGCSDFYKRLINRAKTVEGVESLKGEILAAKP

SEQ ID NO: 722 - protein, 46 aa, ARTIFICIAL SEQUENCE
  Engineered albumin binding polypeptide
LAEAKVLANRELDKYGKSDFYKRLINRAKTVEGVESLKGEILAACP

SEQ ID NO: 723 - protein, 46 aa, ARTIFICIAL SEQUENCE
  Engineered albumin binding polypeptide
LAEAKVLANRELDKYGCSDFYKRLINRAKTVEGVESLKGEILAACP

SEQ ID NO: 724 - protein, 46 aa, ARTIFICIAL SEQUENCE
  Engineered albumin binding polypeptide
LAEAKVLANRELDKYGKSDFYKRLINRAKTVEGVESLKGEILAAKP

SEQ ID NO: 725 - protein, 46 aa, ARTIFICIAL SEQUENCE
  Engineered albumin binding polypeptide
LAEAKVLANRELDKYGCSDFYKRLINKAKTVEGVHTLKHDILAAKP

SEQ ID NO: 726 - protein, 46 aa, ARTIFICIAL SEQUENCE
  Engineered albumin binding polypeptide
LAEAKVLANRELDKYGKSDFYKRLINKAKTVEGVHTLKHDILAACP

SEQ ID NO: 727 - protein, 46 aa, ARTIFICIAL SEQUENCE
  Engineered albumin binding polypeptide
LAEAKVLANRELDKYGCSDFYKRLINKAKTVEGVHTLKHDILAACP

SEQ ID NO: 728 - protein, 46 aa, ARTIFICIAL SEQUENCE
  Engineered albumin binding polypeptide
LAEAKVLANRELDKYGKSDFYKRLINKAKTVEGVHTLKHDILAAKP

SEQ ID NO: 729 - protein, 46 aa, ARTIFICIAL SEQUENCE
  Engineered albumin binding polypeptide
LAEAKVLANRELDKYGCSDFYKRLINKAKTVEGVDALKVHILAAKP

SEQ ID NO: 730 - protein, 46 aa, ARTIFICIAL SEQUENCE
  Engineered albumin binding polypeptide
LAEAKVLANRELDKYGKSDFYKRLINKAKTVEGVDALKVHILAACP

SEQ ID NO: 731 - protein, 46 aa, ARTIFICIAL SEQUENCE
  Engineered albumin binding polypeptide
LAEAKVLANRELDKYGCSDFYKRLINKAKTVEGVDALKVHILAACP

SEQ ID NO: 732 - protein, 46 aa, ARTIFICIAL SEQUENCE
  Engineered albumin binding polypeptide
LAEAKVLANRELDKYGKSDFYKRLINKAKTVEGVDALKVHILAAKP

SEQ ID NO: 733 - protein, 46 aa, ARTIFICIAL SEQUENCE
  Engineered albumin binding polypeptide
LAEAKVLANRELDKYGCSDYYKRLINRARTVEGVDTLKHDILAAKP

SEQ ID NO: 734 - protein, 46 aa, ARTIFICIAL SEQUENCE
  Engineered albumin binding polypeptide
LAEAKVLANRELDKYGKSDYYKRLINRARTVEGVDTLKHDILAACP

SEQ ID NO: 735 - protein, 46 aa, ARTIFICIAL SEQUENCE
  Engineered albumin binding polypeptide
LAEAKVLANRELDKYGCSDYYKRLINRARTVEGVDTLKHDILAACP

SEQ ID NO: 736 - protein, 46 aa, ARTIFICIAL SEQUENCE
  Engineered albumin binding polypeptide
LAEAKVLANRELDKYGKSDYYKRLINRARTVEGVDTLKHDILAAKP

SEQ ID NO: 737 - protein, 46 aa, ARTIFICIAL SEQUENCE
  Engineered albumin binding polypeptide
LAEAKVLANRELDKYGCSDFYKRVINRARTVEGVQALKADILAAKP

SEQ ID NO: 738 - protein, 46 aa, ARTIFICIAL SEQUENCE
  Engineered albumin binding polypeptide
LAEAKVLANRELDKYGKSDFYKRVINRARTVEGVQALKADILAACP

SEQ ID NO: 739 - protein, 46 aa, ARTIFICIAL SEQUENCE
  Engineered albumin binding polypeptide
LAEAKVLANRELDKYGCSDFYKRVINRARTVEGVQALKADILAACP

SEQ ID NO: 740 - protein, 46 aa, ARTIFICIAL SEQUENCE
  Engineered albumin binding polypeptide
LAEAKVLANRELDKYGKSDFYKRVINRARTVEGVQALKADILAAKP

SEQ ID NO: 741 - protein, 46 aa, ARTIFICIAL SEQUENCE
  Engineered albumin binding polypeptide
LAEAKVLANRELDKYGCSDFYKRLINRAKTVEGVESLKADILAAKP

SEQ ID NO: 742 - protein, 46 aa, ARTIFICIAL SEQUENCE
  Engineered albumin binding polypeptide
LAEAKVLANRELDKYGKSDFYKRLINRAKTVEGVESLKADILAACP

SEQ ID NO: 743 - protein, 46 aa, ARTIFICIAL SEQUENCE
  Engineered albumin binding polypeptide
LAEAKVLANRELDKYGCSDFYKRLINRAKTVEGVESLKADILAACP

SEQ ID NO: 744 - protein, 46 aa, ARTIFICIAL SEQUENCE
  Engineered albumin binding polypeptide
LAEAKVLANRELDKYGKSDFYKRLINRAKTVEGVESLKADILAAKP

SEQ ID NO: 745 - protein, 46 aa, ARTIFICIAL SEQUENCE
  Engineered albumin binding polypeptide
LAEAKVLANRELDKYGCSDYYKRLINKAKTVEGVDALKAHILAAKP

SEQ ID NO: 746 - protein, 46 aa, ARTIFICIAL SEQUENCE
  Engineered albumin binding polypeptide
LAEAKVLANRELDKYGKSDYYKRLINKAKTVEGVDALKAHILAACP

SEQ ID NO: 747 - protein, 46 aa, ARTIFICIAL SEQUENCE
  Engineered albumin binding polypeptide
LAEAKVLANRELDKYGCSDYYKRLINKAKTVEGVDALKAHILAACP

SEQ ID NO: 748 - protein, 46 aa, ARTIFICIAL SEQUENCE
  Engineered albumin binding polypeptide
LAEAKVLANRELDKYGKSDYYKRLINKAKTVEGVDALKAHILAAKP

SEQ ID NO: 749 - protein, 46 aa, ARTIFICIAL SEQUENCE
  Engineered albumin binding polypeptide
LAEAKVLANRELDKYGCSDYYKRLINRAKTVEGVESLKTHILAAKP

SEQ ID NO: 750 - protein, 46 aa, ARTIFICIAL SEQUENCE
  Engineered albumin binding polypeptide
LAEAKVLANRELDKYGKSDYYKRLINRAKTVEGVESLKTHILAACP

SEQ ID NO: 751 - protein, 46 aa, ARTIFICIAL SEQUENCE
  Engineered albumin binding polypeptide
LAEAKVLANRELDKYGCSDYYKRLINRAKTVEGVESLKTHILAACP

SEQ ID NO: 752 - protein, 46 aa, ARTIFICIAL SEQUENCE
  Engineered albumin binding polypeptide
LAEAKVLANRELDKYGKSDYYKRLINRAKTVEGVESLKTHILAAKP

SEQ ID NO: 753 - protein, 46 aa, ARTIFICIAL SEQUENCE
  Engineered albumin binding polypeptide
LAEAKVLANRELDKYGCSDFYKRLINRARTVEGVDSLKVEILAAKP

SEQ ID NO: 754 - protein, 46 aa, ARTIFICIAL SEQUENCE
  Engineered albumin binding polypeptide
LAEAKVLANRELDKYGKSDFYKRLINRARTVEGVDSLKVEILAACP

SEQ ID NO: 755 - protein, 46 aa, ARTIFICIAL SEQUENCE
  Engineered albumin binding polypeptide
LAEAKVLANRELDKYGCSDFYKRLINRARTVEGVDSLKVEILAACP

SEQ ID NO: 756 - protein, 46 aa, ARTIFICIAL SEQUENCE
  Engineered albumin binding polypeptide
LAEAKVLANRELDKYGKSDFYKRLINRARTVEGVDSLKVEILAAKP

SEQ ID NO: 757 - protein, 46 aa, ARTIFICIAL SEQUENCE
  Engineered albumin binding polypeptide
LAEAKVLANRELDKYGCSDFYKRVINRAKTVEGVSALKREILAAKP

SEQ ID NO: 758 - protein, 46 aa, ARTIFICIAL SEQUENCE
  Engineered albumin binding polypeptide
LAEAKVLANRELDKYGKSDFYKRVINRAKTVEGVSALKREILAACP

SEQ ID NO: 759 - protein, 46 aa, ARTIFICIAL SEQUENCE
  Engineered albumin binding polypeptide
LAEAKVLANRELDKYGCSDFYKRVINRAKTVEGVSALKREILAACP

SEQ ID NO: 760 - protein, 46 aa, ARTIFICIAL SEQUENCE
  Engineered albumin binding polypeptide
LAEAKVLANRELDKYGKSDFYKRVINRAKTVEGVSALKREILAAKP

SEQ ID NO: 761 - protein, 46 aa, ARTIFICIAL SEQUENCE
  Engineered albumin binding polypeptide
LAEAKVLANRELDKYGCSDFYKRLINRAKTVEGVNALKSDILAAKP

SEQ ID NO: 762 - protein, 46 aa, ARTIFICIAL SEQUENCE
  Engineered albumin binding polypeptide
LAEAKVLANRELDKYGKSDFYKRLINRAKTVEGVNALKSDILAACP

SEQ ID NO: 763 - protein, 46 aa, ARTIFICIAL SEQUENCE
  Engineered albumin binding polypeptide
LAEAKVLANRELDKYGCSDFYKRLINRAKTVEGVNALKSDILAACP

SEQ ID NO: 764 - protein, 46 aa, ARTIFICIAL SEQUENCE
  Engineered albumin binding polypeptide
LAEAKVLANRELDKYGKSDFYKRLINRAKTVEGVNALKSDILAAKP

SEQ ID NO: 765 - protein, 46 aa, ARTIFICIAL SEQUENCE
  Engineered albumin binding polypeptide
LAEAKVLANRELDKYGCSDFYKRLINRAKTVEGVSALKQEILAAKP

SEQ ID NO: 766 - protein, 46 aa, ARTIFICIAL SEQUENCE
  Engineered albumin binding polypeptide
LAEAKVLANRELDKYGKSDFYKRLINRAKTVEGVSALKQEILAACP

SEQ ID NO: 767 - protein, 46 aa, ARTIFICIAL SEQUENCE
  Engineered albumin binding polypeptide
LAEAKVLANRELDKYGCSDFYKRLINRAKTVEGVSALKQEILAACP

SEQ ID NO: 768 - protein, 46 aa, ARTIFICIAL SEQUENCE
  Engineered albumin binding polypeptide
LAEAKVLANRELDKYGKSDFYKRLINRAKTVEGVSALKQEILAAKP

SEQ ID NO: 769 - protein, 46 aa, ARTIFICIAL SEQUENCE
  Engineered albumin binding polypeptide
LAEAKVLANRELDKYGCSDFYKRLINRAKTVEGVQSLKDHILAAKP

SEQ ID NO: 770 - protein, 46 aa, ARTIFICIAL SEQUENCE
  Engineered albumin binding polypeptide
LAEAKVLANRELDKYGKSDFYKRLINRAKTVEGVQSLKDHILAACP

SEQ ID NO: 771 - protein, 46 aa, ARTIFICIAL SEQUENCE
  Engineered albumin binding polypeptide
LAEAKVLANRELDKYGCSDFYKRLINRAKTVEGVQSLKDHILAACP

SEQ ID NO: 772 - protein, 46 aa, ARTIFICIAL SEQUENCE
  Engineered albumin binding polypeptide
LAEAKVLANRELDKYGKSDFYKRLINRAKTVEGVQSLKDHILAAKP

SEQ ID NO: 773 - protein, 46 aa, ARTIFICIAL SEQUENCE
  Engineered albumin binding polypeptide
LAEAKVLANRELDKYGCSDFYKRLINRAKTVEGVDALKCHILAAKP

SEQ ID NO: 774 - protein, 46 aa, ARTIFICIAL SEQUENCE
  Engineered albumin binding polypeptide
LAEAKVLANRELDKYGKSDFYKRLINRAKTVEGVDALKCHILAACP

SEQ ID NO: 775 - protein, 46 aa, ARTIFICIAL SEQUENCE
  Engineered albumin binding polypeptide
LAEAKVLANRELDKYGCSDFYKRLINRAKTVEGVDALKCHILAACP

SEQ ID NO: 776 - protein, 46 aa, ARTIFICIAL SEQUENCE
  Engineered albumin binding polypeptide
LAEAKVLANRELDKYGKSDFYKRLINRAKTVEGVDALKCHILAAKP

SEQ ID NO: 777 - protein, 46 aa, ARTIFICIAL SEQUENCE
  Engineered albumin binding polypeptide
LAEAKVLANRELDKYGCSDFYKRVINKAKTVEGVEALKADILAAKP

SEQ ID NO: 778 - protein, 46 aa, ARTIFICIAL SEQUENCE
  Engineered albumin binding polypeptide
LAEAKVLANRELDKYGKSDFYKRVINKAKTVEGVEALKADILAACP

SEQ ID NO: 779 - protein, 46 aa, ARTIFICIAL SEQUENCE
  Engineered albumin binding polypeptide
LAEAKVLANRELDKYGCSDFYKRVINKAKTVEGVEALKADILAACP

SEQ ID NO: 780 - protein, 46 aa, ARTIFICIAL SEQUENCE
  Engineered albumin binding polypeptide
LAEAKVLANRELDKYGKSDFYKRVINKAKTVEGVEALKADILAAKP

SEQ ID NO: 781 - protein, 46 aa, ARTIFICIAL SEQUENCE
  Engineered albumin binding polypeptide
LAEAKVLANRELDKYGCSDFYKRLINRAKTVEGVETLKRDILAAKP

SEQ ID NO: 782 - protein, 46 aa, ARTIFICIAL SEQUENCE
  Engineered albumin binding polypeptide
LAEAKVLANRELDKYGKSDFYKRLINRAKTVEGVETLKRDILAACP

SEQ ID NO: 783 - protein, 46 aa, ARTIFICIAL SEQUENCE
  Engineered albumin binding polypeptide
LAEAKVLANRELDKYGCSDFYKRLINRAKTVEGVETLKRDILAACP

SEQ ID NO: 784 - protein, 46 aa, ARTIFICIAL SEQUENCE
  Engineered albumin binding polypeptide
LAEAKVLANRELDKYGKSDFYKRLINRAKTVEGVETLKRDILAAKP

SEQ ID NO: 785 - protein, 46 aa, ARTIFICIAL SEQUENCE
  Engineered albumin binding polypeptide
LAEAKVLANRELDKYGCSDFYKRLINRARTVEGVQTLKTDILAAKP

SEQ ID NO: 786 - protein, 46 aa, ARTIFICIAL SEQUENCE
  Engineered albumin binding polypeptide
LAEAKVLANRELDKYGKSDFYKRLINRARTVEGVQTLKTDILAACP

SEQ ID NO: 787 - protein, 46 aa, ARTIFICIAL SEQUENCE
  Engineered albumin binding polypeptide
LAEAKVLANRELDKYGCSDFYKRLINRARTVEGVQTLKTDILAACP

SEQ ID NO: 788 - protein, 46 aa, ARTIFICIAL SEQUENCE
  Engineered albumin binding polypeptide
LAEAKVLANRELDKYGKSDFYKRLINRARTVEGVQTLKTDILAAKP

SEQ ID NO: 789 - protein, 46 aa, ARTIFICIAL SEQUENCE
  Engineered albumin binding polypeptide
LAEAKVLANRELDKYGCSDYYKRLINRAKTVEGVQALKAHILAAKP

SEQ ID NO: 790 - protein, 46 aa, ARTIFICIAL SEQUENCE
  Engineered albumin binding polypeptide
LAEAKVLANRELDKYGKSDYYKRLINRAKTVEGVQALKAHILAACP

SEQ ID NO: 791 - protein, 46 aa, ARTIFICIAL SEQUENCE
  Engineered albumin binding polypeptide
LAEAKVLANRELDKYGCSDYYKRLINRAKTVEGVQALKAHILAACP

SEQ ID NO: 792 - protein, 46 aa, ARTIFICIAL SEQUENCE
  Engineered albumin binding polypeptide
LAEAKVLANRELDKYGKSDYYKRLINRAKTVEGVQALKAHILAAKP

SEQ ID NO: 793 - protein, 46 aa, ARTIFICIAL SEQUENCE
  Engineered albumin binding polypeptide
LAEAKVLANRELDKYGCSDFYKRVINRAKTVEGVNSLKNHILAAKP

SEQ ID NO: 794 - protein, 46 aa, ARTIFICIAL SEQUENCE
  Engineered albumin binding polypeptide
LAEAKVLANRELDKYGKSDFYKRVINRAKTVEGVNSLKNHILAACP

SEQ ID NO: 795 - protein, 46 aa, ARTIFICIAL SEQUENCE
  Engineered albumin binding polypeptide
LAEAKVLANRELDKYGCSDFYKRVINRAKTVEGVNSLKNHILAACP

SEQ ID NO: 796 - protein, 46 aa, ARTIFICIAL SEQUENCE
  Engineered albumin binding polypeptide
LAEAKVLANRELDKYGKSDFYKRVINRAKTVEGVNSLKNHILAAKP

SEQ ID NO: 797 - protein, 46 aa, ARTIFICIAL SEQUENCE
  Engineered albumin binding polypeptide
LAEAKVLANRELDKYGCSDFYKRLINRARTVEGVDSLKRHILAAKP

SEQ ID NO: 798 - protein, 46 aa, ARTIFICIAL SEQUENCE
  Engineered albumin binding polypeptide
LAEAKVLANRELDKYGKSDFYKRLINRARTVEGVDSLKRHILAACP

SEQ ID NO: 799 - protein, 46 aa, ARTIFICIAL SEQUENCE
  Engineered albumin binding polypeptide
LAEAKVLANRELDKYGCSDFYKRLINRARTVEGVDSLKRHILAACP

SEQ ID NO: 800 - protein, 46 aa, ARTIFICIAL SEQUENCE
  Engineered albumin binding polypeptide
LAEAKVLANRELDKYGKSDFYKRLINRARTVEGVDSLKRHILAAKP

SEQ ID NO: 801 - protein, 46 aa, ARTIFICIAL SEQUENCE
  Engineered albumin binding polypeptide
LAEAKVLANRELDKYGCSDYYKRLINKAKTVEGVEALKLHILAAKP

SEQ ID NO: 802 - protein, 46 aa, ARTIFICIAL SEQUENCE
  Engineered albumin binding polypeptide
LAEAKVLANRELDKYGKSDYYKRLINKAKTVEGVEALKLHILAACP

SEQ ID NO: 803 - protein, 46 aa, ARTIFICIAL SEQUENCE
  Engineered albumin binding polypeptide
LAEAKVLANRELDKYGCSDYYKRLINKAKTVEGVEALKLHILAACP

SEQ ID NO: 804 - protein, 46 aa, ARTIFICIAL SEQUENCE
  Engineered albumin binding polypeptide
LAEAKVLANRELDKYGKSDYYKRLINKAKTVEGVEALKLHILAAKP

SEQ ID NO: 805 - protein, 46 aa, ARTIFICIAL SEQUENCE
  Engineered albumin binding polypeptide
LAEAKVLANRELDKYGCSDFYKRLINRAKTVEGVDALKAHILAAKP

SEQ ID NO: 806 - protein, 46 aa, ARTIFICIAL SEQUENCE
  Engineered albumin binding polypeptide
LAEAKVLANRELDKYGKSDFYKRLINRAKTVEGVDALKAHILAACP

SEQ ID NO: 807 - protein, 46 aa, ARTIFICIAL SEQUENCE
  Engineered albumin binding polypeptide
LAEAKVLANRELDKYGCSDFYKRLINRAKTVEGVDALKAHILAACP

SEQ ID NO: 808 - protein, 46 aa, ARTIFICIAL SEQUENCE
  Engineered albumin binding polypeptide
LAEAKVLANRELDKYGKSDFYKRLINRAKTVEGVDALKAHILAAKP

SEQ ID NO: 809 - protein, 46 aa, ARTIFICIAL SEQUENCE
  Engineered albumin binding polypeptide
LAEAKVLANRELDKYGCSDYYKRLINKAKTVEGVQALKAHILAAKP

SEQ ID NO: 810 - protein, 46 aa, ARTIFICIAL SEQUENCE
  Engineered albumin binding polypeptide
LAEAKVLANRELDKYGKSDYYKRLINKAKTVEGVQALKAHILAACP

SEQ ID NO: 811 - protein, 46 aa, ARTIFICIAL SEQUENCE
  Engineered albumin binding polypeptide
LAEAKVLANRELDKYGCSDYYKRLINKAKTVEGVQALKAHILAACP

SEQ ID NO: 812 - protein, 46 aa, ARTIFICIAL SEQUENCE
  Engineered albumin binding polypeptide
LAEAKVLANRELDKYGKSDYYKRLINKAKTVEGVQALKAHILAAKP

SEQ ID NO: 813 - protein, 46 aa, ARTIFICIAL SEQUENCE
  Engineered albumin binding polypeptide
LAEAKVLANRELDKYGCSDFYKRVINRAKTVEGVSALKHHILAAKP

SEQ ID NO: 814 - protein, 46 aa, ARTIFICIAL SEQUENCE
  Engineered albumin binding polypeptide
LAEAKVLANRELDKYGKSDFYKRVINRAKTVEGVSALKHHILAACP

SEQ ID NO: 815 - protein, 46 aa, ARTIFICIAL SEQUENCE
  Engineered albumin binding polypeptide
LAEAKVLANRELDKYGCSDFYKRVINRAKTVEGVSALKHHILAACP

SEQ ID NO: 816 - protein, 46 aa, ARTIFICIAL SEQUENCE
  Engineered albumin binding polypeptide
LAEAKVLANRELDKYGKSDFYKRVINRAKTVEGVSALKHHILAAKP

SEQ ID NO: 817 - protein, 46 aa, ARTIFICIAL SEQUENCE
  Engineered albumin binding polypeptide
LAEAKVLANRELDKYGCSDFYKRLINRAKTVEGVNTLKAHILAAKP

SEQ ID NO: 818 - protein, 46 aa, ARTIFICIAL SEQUENCE
  Engineered albumin binding polypeptide
LAEAKVLANRELDKYGKSDFYKRLINRAKTVEGVNTLKAHILAACP

SEQ ID NO: 819 - protein, 46 aa, ARTIFICIAL SEQUENCE
  Engineered albumin binding polypeptide
LAEAKVLANRELDKYGCSDFYKRLINRAKTVEGVNTLKAHILAACP

SEQ ID NO: 820 - protein, 46 aa, ARTIFICIAL SEQUENCE
  Engineered albumin binding polypeptide
LAEAKVLANRELDKYGKSDFYKRLINRAKTVEGVNTLKAHILAAKP

SEQ ID NO: 821 - protein, 46 aa, ARTIFICIAL SEQUENCE
  Engineered albumin binding polypeptide
LAEAKVLANRELDKYGCSDFYKRLINRAKTVGGVQSLKSHILAAKP

SEQ ID NO: 822 - protein, 46 aa, ARTIFICIAL SEQUENCE
  Engineered albumin binding polypeptide
LAEAKVLANRELDKYGKSDFYKRLINRAKTVGGVQSLKSHILAACP

SEQ ID NO: 823 - protein, 46 aa, ARTIFICIAL SEQUENCE
  Engineered albumin binding polypeptide
LAEAKVLANRELDKYGCSDFYKRLINRAKTVGGVQSLKSHILAACP

SEQ ID NO: 824 - protein, 46 aa, ARTIFICIAL SEQUENCE
  Engineered albumin binding polypeptide
LAEAKVLANRELDKYGKSDFYKRLINRAKTVGGVQSLKSHILAAKP

SEQ ID NO: 825 - protein, 46 aa, ARTIFICIAL SEQUENCE
  Engineered albumin binding polypeptide
LAEAKVLANRELDKYGCSDFYKRVINRAKTVEGVDSLKAHILAAKP

SEQ ID NO: 826 - protein, 46 aa, ARTIFICIAL SEQUENCE
  Engineered albumin binding polypeptide
LAEAKVLANRELDKYGKSDFYKRVINRAKTVEGVDSLKAHILAACP

SEQ ID NO: 827 - protein, 46 aa, ARTIFICIAL SEQUENCE
  Engineered albumin binding polypeptide
LAEAKVLANRELDKYGCSDFYKRVINRAKTVEGVDSLKAHILAACP

SEQ ID NO: 828 - protein, 46 aa, ARTIFICIAL SEQUENCE
  Engineered albumin binding polypeptide
LAEAKVLANRELDKYGKSDFYKRVINRAKTVEGVDSLKAHILAAKP

SEQ ID NO: 829 - protein, 46 aa, ARTIFICIAL SEQUENCE
  Engineered albumin binding polypeptide
LAEAKVLANRELDKYGCSDFYKRLINRARTVEGVQTLKSHILAAKP

SEQ ID NO: 830 - protein, 46 aa, ARTIFICIAL SEQUENCE
  Engineered albumin binding polypeptide
LAEAKVLANRELDKYGKSDFYKRLINRARTVEGVQTLKSHILAACP

SEQ ID NO: 831 - protein, 46 aa, ARTIFICIAL SEQUENCE
  Engineered albumin binding polypeptide
LAEAKVLANRELDKYGCSDFYKRLINRARTVEGVQTLKSHILAACP

SEQ ID NO: 832 - protein, 46 aa, ARTIFICIAL SEQUENCE
  Engineered albumin binding polypeptide
LAEAKVLANRELDKYGKSDFYKRLINRARTVEGVQTLKSHILAAKP

SEQ ID NO: 833 - protein, 46 aa, ARTIFICIAL SEQUENCE
  Engineered albumin binding polypeptide
LAEAKVLANRELDKYGCSDFYKRFINKAKTVEGVETLKSHILAAKP

SEQ ID NO: 834 - protein, 46 aa, ARTIFICIAL SEQUENCE
  Engineered albumin binding polypeptide
LAEAKVLANRELDKYGKSDFYKRFINKAKTVEGVETLKSHILAACP

SEQ ID NO: 835 - protein, 46 aa, ARTIFICIAL SEQUENCE
  Engineered albumin binding polypeptide
LAEAKVLANRELDKYGCSDFYKRFINKAKTVEGVETLKSHILAACP

SEQ ID NO: 836 - protein, 46 aa, ARTIFICIAL SEQUENCE
  Engineered albumin binding polypeptide
LAEAKVLANRELDKYGKSDFYKRFINKAKTVEGVETLKSHILAAKP

SEQ ID NO: 837 - protein, 46 aa, ARTIFICIAL SEQUENCE
  Engineered albumin binding polypeptide
LAEAKVLANRELDKYGCSDFYKRLINRAKTVEGVHSLKDHILAAKP

SEQ ID NO: 838 - protein, 46 aa, ARTIFICIAL SEQUENCE
  Engineered albumin binding polypeptide
LAEAKVLANRELDKYGKSDFYKRLINRAKTVEGVHSLKDHILAACP

SEQ ID NO: 839 - protein, 46 aa, ARTIFICIAL SEQUENCE
  Engineered albumin binding polypeptide
LAEAKVLANRELDKYGCSDFYKRLINRAKTVEGVHSLKDHILAACP

SEQ ID NO: 840 - protein, 46 aa, ARTIFICIAL SEQUENCE
  Engineered albumin binding polypeptide
LAEAKVLANRELDKYGKSDFYKRLINRAKTVEGVHSLKDHILAAKP

SEQ ID NO: 841 - protein, 46 aa, ARTIFICIAL SEQUENCE
  Engineered albumin binding polypeptide
LAEAKVLANRELDKYGCSDYYKRVINKAKTVEGVSSLKAHILAAKP

SEQ ID NO: 842 - protein, 46 aa, ARTIFICIAL SEQUENCE
  Engineered albumin binding polypeptide
LAEAKVLANRELDKYGKSDYYKRVINKAKTVEGVSSLKAHILAACP

SEQ ID NO: 843 - protein, 46 aa, ARTIFICIAL SEQUENCE
  Engineered albumin binding polypeptide
LAEAKVLANRELDKYGCSDYYKRVINKAKTVEGVSSLKAHILAACP

SEQ ID NO: 844 - protein, 46 aa, ARTIFICIAL SEQUENCE
  Engineered albumin binding polypeptide
LAEAKVLANRELDKYGKSDYYKRVINKAKTVEGVSSLKAHILAAKP

SEQ ID NO: 845 - protein, 46 aa, ARTIFICIAL SEQUENCE
  Engineered albumin binding polypeptide
LAEAKVLANRELDKYGCSDFYKRLINKAKTVEGVSTLKHHILAAKP

SEQ ID NO: 846 - protein, 46 aa, ARTIFICIAL SEQUENCE
  Engineered albumin binding polypeptide
LAEAKVLANRELDKYGKSDFYKRLINKAKTVEGVSTLKHHILAACP

SEQ ID NO: 847 - protein, 46 aa, ARTIFICIAL SEQUENCE
  Engineered albumin binding polypeptide
LAEAKVLANRELDKYGCSDFYKRLINKAKTVEGVSTLKHHILAACP

SEQ ID NO: 848 - protein, 46 aa, ARTIFICIAL SEQUENCE
  Engineered albumin binding polypeptide
LAEAKVLANRELDKYGKSDFYKRLINKAKTVEGVSTLKHHILAAKP

SEQ ID NO: 849 - protein, 46 aa, ARTIFICIAL SEQUENCE
  Engineered albumin binding polypeptide
LAEAKVLANRELDKYGCSDFYKRLINRAKTVEGVSTLKHHILAAKP

SEQ ID NO: 850 - protein, 46 aa, ARTIFICIAL SEQUENCE
  Engineered albumin binding polypeptide
LAEAKVLANRELDKYGKSDFYKRLINRAKTVEGVSTLKHHILAACP

SEQ ID NO: 851 - protein, 46 aa, ARTIFICIAL SEQUENCE
  Engineered albumin binding polypeptide
LAEAKVLANRELDKYGCSDFYKRLINRAKTVEGVSTLKHHILAACP

SEQ ID NO: 852 - protein, 46 aa, ARTIFICIAL SEQUENCE
  Engineered albumin binding polypeptide
LAEAKVLANRELDKYGKSDFYKRLINRAKTVEGVSTLKHHILAAKP

SEQ ID NO: 853 - protein, 46 aa, ARTIFICIAL SEQUENCE
  Engineered albumin binding polypeptide
LAEAKVLANRELDKYGCSDFYKRLINRAKTVEGVQALKSHILAAKP

SEQ ID NO: 854 - protein, 46 aa, ARTIFICIAL SEQUENCE
  Engineered albumin binding polypeptide
LAEAKVLANRELDKYGKSDFYKRLINRAKTVEGVQALKSHILAACP

SEQ ID NO: 855 - protein, 46 aa, ARTIFICIAL SEQUENCE
  Engineered albumin binding polypeptide
LAEAKVLANRELDKYGCSDFYKRLINRAKTVEGVQALKSHILAACP

SEQ ID NO: 856 - protein, 46 aa, ARTIFICIAL SEQUENCE
  Engineered albumin binding polypeptide
LAEAKVLANRELDKYGKSDFYKRLINRAKTVEGVQALKSHILAAKP

SEQ ID NO: 857 - protein, 46 aa, ARTIFICIAL SEQUENCE
  Engineered albumin binding polypeptide
LAEAKVLANRELDKYGCSDFYKRLINRAKTVEGVQSLKTHILAAKP

SEQ ID NO: 858 - protein, 46 aa, ARTIFICIAL SEQUENCE
  Engineered albumin binding polypeptide
LAEAKVLANRELDKYGKSDFYKRLINRAKTVEGVQSLKTHILAACP

SEQ ID NO: 859 - protein, 46 aa, ARTIFICIAL SEQUENCE
  Engineered albumin binding polypeptide
LAEAKVLANRELDKYGCSDFYKRLINRAKTVEGVQSLKTHILAACP

SEQ ID NO: 860 - protein, 46 aa, ARTIFICIAL SEQUENCE
  Engineered albumin binding polypeptide
LAEAKVLANRELDKYGKSDFYKRLINRAKTVEGVQSLKTHILAAKP

SEQ ID NO: 861 - protein, 46 aa, ARTIFICIAL SEQUENCE
  Engineered albumin binding polypeptide
LAEAKVLANRELDKYGCSDFYKRLINRAKTVEGVTTLKTHILAAKP

SEQ ID NO: 862 - protein, 46 aa, ARTIFICIAL SEQUENCE
  Engineered albumin binding polypeptide
LAEAKVLANRELDKYGKSDFYKRLINRAKTVEGVTTLKTHILAACP

SEQ ID NO: 863 - protein, 46 aa, ARTIFICIAL SEQUENCE
  Engineered albumin binding polypeptide
LAEAKVLANRELDKYGCSDFYKRLINRAKTVEGVTTLKTHILAACP

SEQ ID NO: 864 - protein, 46 aa, ARTIFICIAL SEQUENCE
  Engineered albumin binding polypeptide
LAEAKVLANRELDKYGKSDFYKRLINRAKTVEGVTTLKTHILAAKP

SEQ ID NO: 865 - protein, 46 aa, ARTIFICIAL SEQUENCE
  Engineered albumin binding polypeptide
LAEAKVLANRELDKYGCSDFYKRLINRAKTVEGVQTLKSHILAAKP

SEQ ID NO: 866 - protein, 46 aa, ARTIFICIAL SEQUENCE
  Engineered albumin binding polypeptide
LAEAKVLANRELDKYGKSDFYKRLINRAKTVEGVQTLKSHILAACP

SEQ ID NO: 867 - protein, 46 aa, ARTIFICIAL SEQUENCE
  Engineered albumin binding polypeptide
LAEAKVLANRELDKYGCSDFYKRLINRAKTVEGVQTLKSHILAACP

SEQ ID NO: 868 - protein, 46 aa, ARTIFICIAL SEQUENCE
  Engineered albumin binding polypeptide
LAEAKVLANRELDKYGKSDFYKRLINRAKTVEGVQTLKSHILAAKP

SEQ ID NO: 869 - protein, 46 aa, ARTIFICIAL SEQUENCE
  Engineered albumin binding polypeptide
LAEAKVLANRELDKYGCSDFYKRLINRAKTVEGVNTLKHHILAAKP

SEQ ID NO: 870 - protein, 46 aa, ARTIFICIAL SEQUENCE
  Engineered albumin binding polypeptide
LAEAKVLANRELDKYGKSDFYKRLINRAKTVEGVNTLKHHILAACP

SEQ ID NO: 871 - protein, 46 aa, ARTIFICIAL SEQUENCE
  Engineered albumin binding polypeptide
LAEAKVLANRELDKYGCSDFYKRLINRAKTVEGVNTLKHHILAACP

SEQ ID NO: 872 - protein, 46 aa, ARTIFICIAL SEQUENCE
  Engineered albumin binding polypeptide
LAEAKVLANRELDKYGKSDFYKRLINRAKTVEGVNTLKHHILAAKP

SEQ ID NO: 873 - protein, 46 aa, ARTIFICIAL SEQUENCE
  Engineered albumin binding polypeptide
LAEAKVLANRELDKYGCSDFYKRLINRAKTVEGVESLKGHILAAKP

SEQ ID NO: 874 - protein, 46 aa, ARTIFICIAL SEQUENCE
  Engineered albumin binding polypeptide
LAEAKVLANRELDKYGKSDFYKRLINRAKTVEGVESLKGHILAACP

SEQ ID NO: 875 - protein, 46 aa, ARTIFICIAL SEQUENCE
  Engineered albumin binding polypeptide
LAEAKVLANRELDKYGCSDFYKRLINRAKTVEGVESLKGHILAACP

SEQ ID NO: 876 - protein, 46 aa, ARTIFICIAL SEQUENCE
  Engineered albumin binding polypeptide
LAEAKVLANRELDKYGKSDFYKRLINRAKTVEGVESLKGHILAAKP

SEQ ID NO: 877 - protein, 46 aa, ARTIFICIAL SEQUENCE
  Engineered albumin binding polypeptide
LAEAKVLANRELDKYGCSDFYKRLINKAKTVEGVHTLKHHILAAKP

SEQ ID NO: 878 - protein, 46 aa, ARTIFICIAL SEQUENCE
  Engineered albumin binding polypeptide
LAEAKVLANRELDKYGKSDFYKRLINKAKTVEGVHTLKHHILAACP

SEQ ID NO: 879 - protein, 46 aa, ARTIFICIAL SEQUENCE
  Engineered albumin binding polypeptide
LAEAKVLANRELDKYGCSDFYKRLINKAKTVEGVHTLKHHILAACP

SEQ ID NO: 880 - protein, 46 aa, ARTIFICIAL SEQUENCE
  Engineered albumin binding polypeptide
LAEAKVLANRELDKYGKSDFYKRLINKAKTVEGVHTLKHHILAAKP

SEQ ID NO: 881 - protein, 46 aa, ARTIFICIAL SEQUENCE
  Engineered albumin binding polypeptide
LAEAKVLANRELDKYGCSDYYKRLINRAKTVEGVHALKAHILAAKP

SEQ ID NO: 882 - protein, 46 aa, ARTIFICIAL SEQUENCE
  Engineered albumin binding polypeptide
LAEAKVLANRELDKYGKSDYYKRLINRAKTVEGVHALKAHILAACP

SEQ ID NO: 883 - protein, 46 aa, ARTIFICIAL SEQUENCE
  Engineered albumin binding polypeptide
LAEAKVLANRELDKYGCSDYYKRLINRAKTVEGVHALKAHILAACP

SEQ ID NO: 884 - protein, 46 aa, ARTIFICIAL SEQUENCE
  Engineered albumin binding polypeptide
LAEAKVLANRELDKYGKSDYYKRLINRAKTVEGVHALKAHILAAKP

SEQ ID NO: 885 - protein, 46 aa, ARTIFICIAL SEQUENCE
  Engineered albumin binding polypeptide
LAEAKVLANRELDKYGCSDYYKRLINRARTVEGVDTLKHHILAAKP

SEQ ID NO: 886 - protein, 46 aa, ARTIFICIAL SEQUENCE
  Engineered albumin binding polypeptide
LAEAKVLANRELDKYGKSDYYKRLINRARTVEGVDTLKHHILAACP

SEQ ID NO: 887 - protein, 46 aa, ARTIFICIAL SEQUENCE
  Engineered albumin binding polypeptide
LAEAKVLANRELDKYGCSDYYKRLINRARTVEGVDTLKHHILAACP

SEQ ID NO: 888 - protein, 46 aa, ARTIFICIAL SEQUENCE
  Engineered albumin binding polypeptide
LAEAKVLANRELDKYGKSDYYKRLINRARTVEGVDTLKHHILAAKP

SEQ ID NO: 889 - protein, 46 aa, ARTIFICIAL SEQUENCE
  Engineered albumin binding polypeptide
LAEAKVLANRELDKYGCSDFYKRVINRARTVEGVQALKAHILAAKP

SEQ ID NO: 890 - protein, 46 aa, ARTIFICIAL SEQUENCE
  Engineered albumin binding polypeptide
LAEAKVLANRELDKYGKSDFYKRVINRARTVEGVQALKAHILAACP

SEQ ID NO: 891 - protein, 46 aa, ARTIFICIAL SEQUENCE
  Engineered albumin binding polypeptide
LAEAKVLANRELDKYGCSDFYKRVINRARTVEGVQALKAHILAACP

SEQ ID NO: 892 - protein, 46 aa, ARTIFICIAL SEQUENCE
  Engineered albumin binding polypeptide
LAEAKVLANRELDKYGKSDFYKRVINRARTVEGVQALKAHILAAKP

SEQ ID NO: 893 - protein, 46 aa, ARTIFICIAL SEQUENCE
  Engineered albumin binding polypeptide
LAEAKVLANRELDKYGCSDFYKRLINRAKTVEGVESLKAHILAAKP

SEQ ID NO: 894 - protein, 46 aa, ARTIFICIAL SEQUENCE
  Engineered albumin binding polypeptide
LAEAKVLANRELDKYGKSDFYKRLINRAKTVEGVESLKAHILAACP

SEQ ID NO: 895 - protein, 46 aa, ARTIFICIAL SEQUENCE
  Engineered albumin binding polypeptide
LAEAKVLANRELDKYGCSDFYKRLINRAKTVEGVESLKAHILAACP

SEQ ID NO: 896 - protein, 46 aa, ARTIFICIAL SEQUENCE
  Engineered albumin binding polypeptide
LAEAKVLANRELDKYGKSDFYKRLINRAKTVEGVESLKAHILAAKP

SEQ ID NO: 897 - protein, 46 aa, ARTIFICIAL SEQUENCE
  Engineered albumin binding polypeptide
LAEAKVLANRELDKYGCSDFYKRLINRARTVEGVDSLKVHILAAKP

SEQ ID NO: 898 - protein, 46 aa, ARTIFICIAL SEQUENCE
  Engineered albumin binding polypeptide
LAEAKVLANRELDKYGKSDFYKRLINRARTVEGVDSLKVHILAACP

SEQ ID NO: 899 - protein, 46 aa, ARTIFICIAL SEQUENCE
  Engineered albumin binding polypeptide
LAEAKVLANRELDKYGCSDFYKRLINRARTVEGVDSLKVHILAACP

SEQ ID NO: 900 - protein, 46 aa, ARTIFICIAL SEQUENCE
  Engineered albumin binding polypeptide
LAEAKVLANRELDKYGKSDFYKRLINRARTVEGVDSLKVHILAAKP

SEQ ID NO: 901 - protein, 46 aa, ARTIFICIAL SEQUENCE
  Engineered albumin binding polypeptide
LAEAKVLANRELDKYGCSDFYKRVINRAKTVEGVSALKRHILAAKP

SEQ ID NO: 902 - protein, 46 aa, ARTIFICIAL SEQUENCE
  Engineered albumin binding polypeptide
LAEAKVLANRELDKYGKSDFYKRVINRAKTVEGVSALKRHILAACP

SEQ ID NO: 903 - protein, 46 aa, ARTIFICIAL SEQUENCE
  Engineered albumin binding polypeptide
LAEAKVLANRELDKYGCSDFYKRVINRAKTVEGVSALKRHILAACP

SEQ ID NO: 904 - protein, 46 aa, ARTIFICIAL SEQUENCE
  Engineered albumin binding polypeptide
LAEAKVLANRELDKYGKSDFYKRVINRAKTVEGVSALKRHILAAKP

SEQ ID NO: 905 - protein, 46 aa, ARTIFICIAL SEQUENCE
  Engineered albumin binding polypeptide
LAEAKVLANRELDKYGCSDFYKRLINRAKTVEGVNALKSHILAAKP

SEQ ID NO: 906 - protein, 46 aa, ARTIFICIAL SEQUENCE
  Engineered albumin binding polypeptide
LAEAKVLANRELDKYGKSDFYKRLINRAKTVEGVNALKSHILAACP

SEQ ID NO: 907 - protein, 46 aa, ARTIFICIAL SEQUENCE
  Engineered albumin binding polypeptide
LAEAKVLANRELDKYGCSDFYKRLINRAKTVEGVNALKSHILAACP

SEQ ID NO: 908 - protein, 46 aa, ARTIFICIAL SEQUENCE
  Engineered albumin binding polypeptide
LAEAKVLANRELDKYGKSDFYKRLINRAKTVEGVNALKSHILAAKP

SEQ ID NO: 909 - protein, 46 aa, ARTIFICIAL SEQUENCE
  Engineered albumin binding polypeptide
LAEAKVLANRELDKYGCSDFYKRLINRAKTVEGVSALKQHILAAKP

SEQ ID NO: 910 - protein, 46 aa, ARTIFICIAL SEQUENCE
  Engineered albumin binding polypeptide
LAEAKVLANRELDKYGKSDFYKRLINRAKTVEGVSALKQHILAACP

SEQ ID NO: 911 - protein, 46 aa, ARTIFICIAL SEQUENCE
  Engineered albumin binding polypeptide
LAEAKVLANRELDKYGCSDFYKRLINRAKTVEGVSALKQHILAACP

SEQ ID NO: 912 - protein, 46 aa, ARTIFICIAL SEQUENCE
  Engineered albumin binding polypeptide
LAEAKVLANRELDKYGKSDFYKRLINRAKTVEGVSALKQHILAAKP

SEQ ID NO: 913 - protein, 46 aa, ARTIFICIAL SEQUENCE
  Engineered albumin binding polypeptide
LAEAKVLANRELDKYGCSDFYKRVINKAKTVEGVEALKAHILAAKP

SEQ ID NO: 914 - protein, 46 aa, ARTIFICIAL SEQUENCE
  Engineered albumin binding polypeptide
LAEAKVLANRELDKYGKSDFYKRVINKAKTVEGVEALKAHILAACP

SEQ ID NO: 915 - protein, 46 aa, ARTIFICIAL SEQUENCE
  Engineered albumin binding polypeptide
LAEAKVLANRELDKYGCSDFYKRVINKAKTVEGVEALKAHILAACP

SEQ ID NO: 916 - protein, 46 aa, ARTIFICIAL SEQUENCE
  Engineered albumin binding polypeptide
LAEAKVLANRELDKYGKSDFYKRVINKAKTVEGVEALKAHILAAKP

SEQ ID NO: 917 - protein, 46 aa, ARTIFICIAL SEQUENCE
  Engineered albumin binding polypeptide
LAEAKVLANRELDKYGCSDFYKRLINRAKTVEGVETLKRHILAAKP

SEQ ID NO: 918 - protein, 46 aa, ARTIFICIAL SEQUENCE
  Engineered albumin binding polypeptide
LAEAKVLANRELDKYGKSDFYKRLINRAKTVEGVETLKRHILAACP

SEQ ID NO: 919 - protein, 46 aa, ARTIFICIAL SEQUENCE
  Engineered albumin binding polypeptide
LAEAKVLANRELDKYGCSDFYKRLINRAKTVEGVETLKRHILAACP

SEQ ID NO: 920 - protein, 46 aa, ARTIFICIAL SEQUENCE
  Engineered albumin binding polypeptide
LAEAKVLANRELDKYGKSDFYKRLINRAKTVEGVETLKRHILAAKP

SEQ ID NO: 921 - protein, 46 aa, ARTIFICIAL SEQUENCE
  Engineered albumin binding polypeptide
LAEAKVLANRELDKYGCSDFYKRLINRARTVEGVQTLKTHILAAKP

SEQ ID NO: 922 - protein, 46 aa, ARTIFICIAL SEQUENCE
  Engineered albumin binding polypeptide
LAEAKVLANRELDKYGKSDFYKRLINRARTVEGVQTLKTHILAACP

SEQ ID NO: 923 - protein, 46 aa, ARTIFICIAL SEQUENCE
  Engineered albumin binding polypeptide
LAEAKVLANRELDKYGCSDFYKRLINRARTVEGVQTLKTHILAACP

SEQ ID NO: 924 - protein, 46 aa, ARTIFICIAL SEQUENCE
  Engineered albumin binding polypeptide
LAEAKVLANRELDKYGKSDFYKRLINRARTVEGVQTLKTHILAAKP

SEQ ID NO: 925 - protein, 46 aa, ARTIFICIAL SEQUENCE
  Engineered albumin binding polypeptide
LAEAKVLANRELDKYGCSDFYKRLINKAKTVEGVEALKLHILAAKP

SEQ ID NO: 926 - protein, 46 aa, ARTIFICIAL SEQUENCE
  Engineered albumin binding polypeptide
LAEAKVLANRELDKYGKSDFYKRLINKAKTVEGVEALKLHILAACP

SEQ ID NO: 927 - protein, 46 aa, ARTIFICIAL SEQUENCE
  Engineered albumin binding polypeptide
LAEAKVLANRELDKYGCSDFYKRLINKAKTVEGVEALKLHILAACP

SEQ ID NO: 928 - protein, 46 aa, ARTIFICIAL SEQUENCE
  Engineered albumin binding polypeptide
LAEAKVLANRELDKYGKSDFYKRLINKAKTVEGVEALKLHILAAKP

SEQ ID NO: 929 - protein, 46 aa, ARTIFICIAL SEQUENCE
  Engineered albumin binding polypeptide
LAEAKVLANRELDKYGCSDYYKNLINRARTVEGVEALKLHILAAKP

SEQ ID NO: 930 - protein, 46 aa, ARTIFICIAL SEQUENCE
  Engineered albumin binding polypeptide
LAEAKVLANRELDKYGKSDYYKNLINRARTVEGVEALKLHILAACP

SEQ ID NO: 931 - protein, 46 aa, ARTIFICIAL SEQUENCE
  Engineered albumin binding polypeptide
LAEAKVLANRELDKYGCSDYYKNLINRARTVEGVEALKLHILAACP

SEQ ID NO: 932 - protein, 46 aa, ARTIFICIAL SEQUENCE
  Engineered albumin binding polypeptide
LAEAKVLANRELDKYGKSDYYKNLINRARTVEGVEALKLHILAAKP

SEQ ID NO: 933 - protein, 46 aa, ARTIFICIAL SEQUENCE
  Engineered albumin binding polypeptide
LAEAKVLANRELDKYGCSDYYKNIINRAKTVEGVEALKLHILAAKP

SEQ ID NO: 934 - protein, 46 aa, ARTIFICIAL SEQUENCE
  Engineered albumin binding polypeptide
LAEAKVLANRELDKYGKSDYYKNIINRAKTVEGVEALKLHILAACP

SEQ ID NO: 935 - protein, 46 aa, ARTIFICIAL SEQUENCE
  Engineered albumin binding polypeptide
LAEAKVLANRELDKYGCSDYYKNIINRAKTVEGVEALKLHILAACP

SEQ ID NO: 936 - protein, 46 aa, ARTIFICIAL SEQUENCE
  Engineered albumin binding polypeptide
LAEAKVLANRELDKYGKSDYYKNIINRAKTVEGVEALKLHILAAKP

SEQ ID NO: 937 - protein, 46 aa, ARTIFICIAL SEQUENCE
  Engineered albumin binding polypeptide
LAEAKVLANRELDKYGCSDFYKNLINRAKTVEGVEALKLHILAAKP

SEQ ID NO: 938 - protein, 46 aa, ARTIFICIAL SEQUENCE
  Engineered albumin binding polypeptide
LAEAKVLANRELDKYGKSDFYKNLINRAKTVEGVEALKLHILAACP

SEQ ID NO: 939 - protein, 46 aa, ARTIFICIAL SEQUENCE
  Engineered albumin binding polypeptide
LAEAKVLANRELDKYGCSDFYKNLINRAKTVEGVEALKLHILAACP

SEQ ID NO: 940 - protein, 46 aa, ARTIFICIAL SEQUENCE
  Engineered albumin binding polypeptide
LAEAKVLANRELDKYGKSDFYKNLINRAKTVEGVEALKLHILAAKP

SEQ ID NO: 941 - protein, 46 aa, ARTIFICIAL SEQUENCE
  Engineered albumin binding polypeptide
LAEAKVLANRELDKYGCSDFYKNVINKAKTVEGVEALKLHILAAKP

SEQ ID NO: 942 - protein, 46 aa, ARTIFICIAL SEQUENCE
  Engineered albumin binding polypeptide
LAEAKVLANRELDKYGKSDFYKNVINKAKTVEGVEALKLHILAACP

SEQ ID NO: 943 - protein, 46 aa, ARTIFICIAL SEQUENCE
  Engineered albumin binding polypeptide
LAEAKVLANRELDKYGCSDFYKNVINKAKTVEGVEALKLHILAACP

SEQ ID NO: 944 - protein, 46 aa, ARTIFICIAL SEQUENCE
  Engineered albumin binding polypeptide
LAEAKVLANRELDKYGKSDFYKNVINKAKTVEGVEALKLHILAAKP

SEQ ID NO: 945 - protein, 46 aa, ARTIFICIAL SEQUENCE
  Engineered albumin binding polypeptide
LAEAKVLANRELDKYGCSDYYKNLINRAKTVEGVEALKLHILAAKP

SEQ ID NO: 946 - protein, 46 aa, ARTIFICIAL SEQUENCE
  Engineered albumin binding polypeptide
LAEAKVLANRELDKYGKSDYYKNLINRAKTVEGVEALKLHILAACP

SEQ ID NO: 947 - protein, 46 aa, ARTIFICIAL SEQUENCE
  Engineered albumin binding polypeptide
LAEAKVLANRELDKYGCSDYYKNLINRAKTVEGVEALKLHILAACP

SEQ ID NO: 948 - protein, 46 aa, ARTIFICIAL SEQUENCE
  Engineered albumin binding polypeptide
LAEAKVLANRELDKYGKSDYYKNLINRAKTVEGVEALKLHILAAKP

SEQ ID NO: 949 - protein, 46 aa, ARTIFICIAL SEQUENCE
  Engineered albumin binding polypeptide
LAEAKVLANRELDKYGCSDYYKNLINRARTVEGVHALIDHILAAKP

SEQ ID NO: 950 - protein, 46 aa, ARTIFICIAL SEQUENCE
  Engineered albumin binding polypeptide
LAEAKVLANRELDKYGKSDYYKNLINRARTVEGVHALIDHILAACP

SEQ ID NO: 951 - protein, 46 aa, ARTIFICIAL SEQUENCE
  Engineered albumin binding polypeptide
LAEAKVLANRELDKYGCSDYYKNLINRARTVEGVHALIDHILAACP

SEQ ID NO: 952 - protein, 46 aa, ARTIFICIAL SEQUENCE
  Engineered albumin binding polypeptide
LAEAKVLANRELDKYGKSDYYKNLINRARTVEGVHALIDHILAAKP

SEQ ID NO: 953 - protein, 46 aa, ARTIFICIAL SEQUENCE
  Engineered albumin binding polypeptide
LAEAKVLANRELDKYGCSDYYKNLINNAKTVEGVKALIDEILAAKP

SEQ ID NO: 954 - protein, 46 aa, ARTIFICIAL SEQUENCE
  Engineered albumin binding polypeptide
LAEAKVLANRELDKYGKSDYYKNLINNAKTVEGVKALIDEILAACP

SEQ ID NO: 955 - protein, 46 aa, ARTIFICIAL SEQUENCE
  Engineered albumin binding polypeptide
LAEAKVLANRELDKYGCSDYYKNLINNAKTVEGVKALIDEILAACP

SEQ ID NO: 956 - protein, 46 aa, ARTIFICIAL SEQUENCE
  Engineered albumin binding polypeptide
LAEAKVLANRELDKYGKSDYYKNLINNAKTVEGVKALIDEILAAKP

SEQ ID NO: 957 - protein, 46 aa, ARTIFICIAL SEQUENCE
  Engineered albumin binding polypeptide
LAEAKVLALRELDKYGCSDFYKRLINKAKTVEGVEALKLHILAAKP

SEQ ID NO: 958 - protein, 46 aa, ARTIFICIAL SEQUENCE
  Engineered albumin binding polypeptide
LAEAKVLALRELDKYGKSDFYKRLINKAKTVEGVEALKLHILAACP

SEQ ID NO: 959 - protein, 46 aa, ARTIFICIAL SEQUENCE
  Engineered albumin binding polypeptide
LAEAKVLALRELDKYGCSDFYKRLINKAKTVEGVEALKLHILAACP

SEQ ID NO: 960 - protein, 46 aa, ARTIFICIAL SEQUENCE
  Engineered albumin binding polypeptide
LAEAKVLALRELDKYGKSDFYKRLINKAKTVEGVEALKLHILAAKP

SEQ ID NO: 961 - protein, 46 aa, ARTIFICIAL SEQUENCE
  Engineered albumin binding polypeptide
LAEAKVLALRELDKYGCSDYYKRLISKAKTVEGVKALISEILAAKP

SEQ ID NO: 962 - protein, 46 aa, ARTIFICIAL SEQUENCE
  Engineered albumin binding polypeptide
LAEAKVLALRELDKYGKSDYYKRLISKAKTVEGVKALISEILAACP

SEQ ID NO: 963 - protein, 46 aa, ARTIFICIAL SEQUENCE
  Engineered albumin binding polypeptide
LAEAKVLALRELDKYGCSDYYKRLISKAKTVEGVKALISEILAACP

SEQ ID NO: 964 - protein, 46 aa, ARTIFICIAL SEQUENCE
  Engineered albumin binding polypeptide
LAEAKVLALRELDKYGKSDYYKRLISKAKTVEGVKALISEILAAKP

SEQ ID NO: 965 - protein, 46 aa, ARTIFICIAL SEQUENCE
  Engineered albumin binding polypeptide
LAEAKVLAIRELDKYGCSDFYKRLINKAKTVEGVEALKLHILAAKP

SEQ ID NO: 966 - protein, 46 aa, ARTIFICIAL SEQUENCE
  Engineered albumin binding polypeptide
LAEAKVLAIRELDKYGKSDFYKRLINKAKTVEGVEALKLHILAACP

SEQ ID NO: 967 - protein, 46 aa, ARTIFICIAL SEQUENCE
  Engineered albumin binding polypeptide
LAEAKVLAIRELDKYGCSDFYKRLINKAKTVEGVEALKLHILAACP

SEQ ID NO: 968 - protein, 46 aa, ARTIFICIAL SEQUENCE
  Engineered albumin binding polypeptide
LAEAKVLAIRELDKYGKSDFYKRLINKAKTVEGVEALKLHILAAKP

SEQ ID NO: 969 - protein, 46 aa, ARTIFICIAL SEQUENCE
  Engineered albumin binding polypeptide
LAEAKVLAIRELDKYGCSDYYKRLISKAKTVEGVKALISEILAAKP

SEQ ID NO: 970 - protein, 46 aa, ARTIFICIAL SEQUENCE
  Engineered albumin binding polypeptide
LAEAKVLAIRELDKYGKSDYYKRLISKAKTVEGVKALISEILAACP

SEQ ID NO: 971 - protein, 46 aa, ARTIFICIAL SEQUENCE
  Engineered albumin binding polypeptide
LAEAKVLAIRELDKYGCSDYYKRLISKAKTVEGVKALISEILAACP

SEQ ID NO: 972 - protein, 46 aa, ARTIFICIAL SEQUENCE
  Engineered albumin binding polypeptide
LAEAKVLAIRELDKYGKSDYYKRLISKAKTVEGVKALISEILAAKP

SEQ ID NO: 973 - protein, 46 aa, ARTIFICIAL SEQUENCE
  Engineered albumin binding polypeptide
LAEAKVLAIKELDKYGCSDYYKRLISKAKTVEGVKALISEILAAKP

SEQ ID NO: 974 - protein, 46 aa, ARTIFICIAL SEQUENCE
  Engineered albumin binding polypeptide
LAEAKVLAIKELDKYGKSDYYKRLISKAKTVEGVKALISEILAACP

SEQ ID NO: 975 - protein, 46 aa, ARTIFICIAL SEQUENCE
  Engineered albumin binding polypeptide
LAEAKVLAIKELDKYGCSDYYKRLISKAKTVEGVKALISEILAACP

SEQ ID NO: 976 - protein, 46 aa, ARTIFICIAL SEQUENCE
  Engineered albumin binding polypeptide
LAEAKVLAIKELDKYGKSDYYKRLISKAKTVEGVKALISEILAAKP

SEQ ID NO: 977 - protein, 46 aa, ARTIFICIAL SEQUENCE
  Engineered albumin binding polypeptide
LAEAKELANRELDKYGCSDYYKRLISKAKTVEGVKALISEILAAKP

SEQ ID NO: 978 - protein, 46 aa, ARTIFICIAL SEQUENCE
  Engineered albumin binding polypeptide
LAEAKELANRELDKYGKSDYYKRLISKAKTVEGVKALISEILAACP

SEQ ID NO: 979 - protein, 46 aa, ARTIFICIAL SEQUENCE
  Engineered albumin binding polypeptide
LAEAKELANRELDKYGCSDYYKRLISKAKTVEGVKALISEILAACP

SEQ ID NO: 980 - protein, 46 aa, ARTIFICIAL SEQUENCE
  Engineered albumin binding polypeptide
LAEAKELANRELDKYGKSDYYKRLISKAKTVEGVKALISEILAAKP

SEQ ID NO: 981 - protein, 46 aa, ARTIFICIAL SEQUENCE
  Engineered albumin binding polypeptide
LAEAKVDANRELDKYGCSDYYKRLISKAKTVEGVKALISEILAAKP

SEQ ID NO: 982 - protein, 46 aa, ARTIFICIAL SEQUENCE
  Engineered albumin binding polypeptide
LAEAKVDANRELDKYGKSDYYKRLISKAKTVEGVKALISEILAACP

SEQ ID NO: 983 - protein, 46 aa, ARTIFICIAL SEQUENCE
  Engineered albumin binding polypeptide
LAEAKVDANRELDKYGCSDYYKRLISKAKTVEGVKALISEILAACP

SEQ ID NO: 984 - protein, 46 aa, ARTIFICIAL SEQUENCE
  Engineered albumin binding polypeptide
LAEAKVDANRELDKYGKSDYYKRLISKAKTVEGVKALISEILAAKP

SEQ ID NO: 985 - protein, 46 aa, ARTIFICIAL SEQUENCE
  Engineered albumin binding polypeptide
LAEAKEDANRELDKYGCSDYYKRLISKAKTVEGVKALISEILAAKP

SEQ ID NO: 986 - protein, 46 aa, ARTIFICIAL SEQUENCE
  Engineered albumin binding polypeptide
LAEAKEDANRELDKYGKSDYYKRLISKAKTVEGVKALISEILAACP

SEQ ID NO: 987 - protein, 46 aa, ARTIFICIAL SEQUENCE
  Engineered albumin binding polypeptide
LAEAKEDANRELDKYGCSDYYKRLISKAKTVEGVKALISEILAACP

SEQ ID NO: 988 - protein, 46 aa, ARTIFICIAL SEQUENCE
  Engineered albumin binding polypeptide
LAEAKEDANRELDKYGKSDYYKRLISKAKTVEGVKALISEILAAKP

SEQ ID NO: 989 - protein, 46 aa, ARTIFICIAL SEQUENCE
  Engineered albumin binding polypeptide
LAEAKEDAIKELDKYGCSDYYKRLISKAKTVEGVKALISEILAAKP

SEQ ID NO: 990 - protein, 46 aa, ARTIFICIAL SEQUENCE
  Engineered albumin binding polypeptide
LAEAKEDAIKELDKYGKSDYYKRLISKAKTVEGVKALISEILAACP

SEQ ID NO: 991 - protein, 46 aa, ARTIFICIAL SEQUENCE
  Engineered albumin binding polypeptide
LAEAKEDAIKELDKYGCSDYYKRLISKAKTVEGVKALISEILAACP

SEQ ID NO: 992 - protein, 46 aa, ARTIFICIAL SEQUENCE
  Engineered albumin binding polypeptide
LAEAKEDAIKELDKYGKSDYYKRLISKAKTVEGVKALISEILAAKP

SEQ ID NO: 993 - protein, 46 aa, ARTIFICIAL SEQUENCE
  Engineered albumin binding polypeptide
LAEAKVLALKELDKYGCSDYYKRLISKAKTVEGVKALISEILAAKP

SEQ ID NO: 994 - protein, 46 aa, ARTIFICIAL SEQUENCE
  Engineered albumin binding polypeptide
LAEAKVLALKELDKYGKSDYYKRLISKAKTVEGVKALISEILAACP

SEQ ID NO: 995 - protein, 46 aa, ARTIFICIAL SEQUENCE
  Engineered albumin binding polypeptide
LAEAKVLALKELDKYGCSDYYKRLISKAKTVEGVKALISEILAACP

SEQ ID NO: 996 - protein, 46 aa, ARTIFICIAL SEQUENCE
  Engineered albumin binding polypeptide
LAEAKVLALKELDKYGKSDYYKRLISKAKTVEGVKALISEILAAKP

SEQ ID NO: 997 - protein, 46 aa, ARTIFICIAL SEQUENCE
  Engineered albumin binding polypeptide
LAEAKELAIKELDKYGCSDYYKRLISKAKTVEGVKALISEILAAKP

SEQ ID NO: 998 - protein, 46 aa, ARTIFICIAL SEQUENCE
  Engineered albumin binding polypeptide
LAEAKELAIKELDKYGKSDYYKRLISKAKTVEGVKALISEILAACP

SEQ ID NO: 999 - protein, 46 aa, ARTIFICIAL SEQUENCE
  Engineered albumin binding polypeptide
LAEAKELAIKELDKYGCSDYYKRLISKAKTVEGVKALISEILAACP

SEQ ID NO: 1000 - protein, 46 aa, ARTIFICIAL SEQUENCE
  Engineered albumin binding polypeptide
LAEAKELAIKELDKYGKSDYYKRLISKAKTVEGVKALISEILAAKP

SEQ ID NO: 1001 - protein, 46 aa, ARTIFICIAL SEQUENCE
  Engineered albumin binding polypeptide
LAEAKVDAIKELDKYGCSDYYKRLISKAKTVEGVKALISEILAAKP

SEQ ID NO: 1002 - protein, 46 aa, ARTIFICIAL SEQUENCE
  Engineered albumin binding polypeptide
LAEAKVDAIKELDKYGKSDYYKRLISKAKTVEGVKALISEILAACP

SEQ ID NO: 1003 - protein, 46 aa, ARTIFICIAL SEQUENCE
  Engineered albumin binding polypeptide
LAEAKVDAIKELDKYGCSDYYKRLISKAKTVEGVKALISEILAACP

SEQ ID NO: 1004 - protein, 46 aa, ARTIFICIAL SEQUENCE
  Engineered albumin binding polypeptide
LAEAKVDAIKELDKYGKSDYYKRLISKAKTVEGVKALISEILAAKP

SEQ ID NO: 1005 - protein, 46 aa, ARTIFICIAL SEQUENCE
  Engineered albumin binding polypeptide
LASAKEAANAELDAYGCSDFYKRLIDKAKTVEGVEALKDAILAAKP

SEQ ID NO: 1006 - protein, 46 aa, ARTIFICIAL SEQUENCE
  Engineered albumin binding polypeptide
LASAKEAANAELDAYGKSDFYKRLIDKAKTVEGVEALKDAILAACP

SEQ ID NO: 1007 - protein, 46 aa, ARTIFICIAL SEQUENCE
  Engineered albumin binding polypeptide
LASAKEAANAELDAYGCSDFYKRLIDKAKTVEGVEALKDAILAACP

SEQ ID NO: 1008 - protein, 46 aa, ARTIFICIAL SEQUENCE
  Engineered albumin binding polypeptide
LASAKEAANAELDAYGKSDFYKRLIDKAKTVEGVEALKDAILAAKP

SEQ ID NO: 1009 - protein, 46 aa, ARTIFICIAL SEQUENCE
  Engineered albumin binding polypeptide
LASAKEAANSELDAYGCSDFYKRLIDKAKTVEGVEALKDAILAAKP

SEQ ID NO: 1010 - protein, 46 aa, ARTIFICIAL SEQUENCE
  Engineered albumin binding polypeptide
LASAKEAANSELDAYGKSDFYKRLIDKAKTVEGVEALKDAILAACP

SEQ ID NO: 1011 - protein, 46 aa, ARTIFICIAL SEQUENCE
  Engineered albumin binding polypeptide
LASAKEAANSELDAYGCSDFYKRLIDKAKTVEGVEALKDAILAACP

SEQ ID NO: 1012 - protein, 46 aa, ARTIFICIAL SEQUENCE
  Engineered albumin binding polypeptide
LASAKEAANSELDAYGKSDFYKRLIDKAKTVEGVEALKDAILAAKP

SEQ ID NO: 1013 - protein, 46 aa, ARTIFICIAL SEQUENCE
  Engineered albumin binding polypeptide
LASAKESANSELDAYGCSDFYKRLIDKAKTVEGVEALKDAILAAKP

SEQ ID NO: 1014 - protein, 46 aa, ARTIFICIAL SEQUENCE
  Engineered albumin binding polypeptide
LASAKESANSELDAYGKSDFYKRLIDKAKTVEGVEALKDAILAACP

SEQ ID NO: 1015 - protein, 46 aa, ARTIFICIAL SEQUENCE
  Engineered albumin binding polypeptide
LASAKESANSELDAYGCSDFYKRLIDKAKTVEGVEALKDAILAACP

SEQ ID NO: 1016 - protein, 46 aa, ARTIFICIAL SEQUENCE
  Engineered albumin binding polypeptide
LASAKESANSELDAYGKSDFYKRLIDKAKTVEGVEALKDAILAAKP

SEQ ID NO: 1017 - protein, 46 aa, ARTIFICIAL SEQUENCE
  Engineered albumin binding polypeptide
LASAKESANAELDAYGCSDFYKRLIDKAKTVEGVEALKDAILAAKP

SEQ ID NO: 1018 - protein, 46 aa, ARTIFICIAL SEQUENCE
  Engineered albumin binding polypeptide
LASAKESANAELDAYGKSDFYKRLIDKAKTVEGVEALKDAILAACP

SEQ ID NO: 1019 - protein, 46 aa, ARTIFICIAL SEQUENCE
  Engineered albumin binding polypeptide
LASAKESANAELDAYGCSDFYKRLIDKAKTVEGVEALKDAILAACP

SEQ ID NO: 1020 - protein, 46 aa, ARTIFICIAL SEQUENCE
  Engineered albumin binding polypeptide
LASAKESANAELDAYGKSDFYKRLIDKAKTVEGVEALKDAILAAKP

SEQ ID NO: 1021 - protein, 46 aa, ARTIFICIAL SEQUENCE
  Engineered albumin binding polypeptide
LASAKSAANAELDAYGCSDFYKRLIDKAKTVEGVEALKDAILAAKP

SEQ ID NO: 1022 - protein, 46 aa, ARTIFICIAL SEQUENCE
  Engineered albumin binding polypeptide
LASAKSAANAELDAYGKSDFYKRLIDKAKTVEGVEALKDAILAACP

SEQ ID NO: 1023 - protein, 46 aa, ARTIFICIAL SEQUENCE
  Engineered albumin binding polypeptide
LASAKSAANAELDAYGCSDFYKRLIDKAKTVEGVEALKDAILAACP

SEQ ID NO: 1024 - protein, 46 aa, ARTIFICIAL SEQUENCE
  Engineered albumin binding polypeptide
LASAKSAANAELDAYGKSDFYKRLIDKAKTVEGVEALKDAILAAKP

SEQ ID NO: 1025 - protein, 46 aa, ARTIFICIAL SEQUENCE
  Engineered albumin binding polypeptide
LASAKSAANSELDAYGCSDFYKRLIDKAKTVEGVEALKDAILAAKP

SEQ ID NO: 1026 - protein, 46 aa, ARTIFICIAL SEQUENCE
  Engineered albumin binding polypeptide
LASAKSAANSELDAYGKSDFYKRLIDKAKTVEGVEALKDAILAACP

SEQ ID NO: 1027 - protein, 46 aa, ARTIFICIAL SEQUENCE
  Engineered albumin binding polypeptide
LASAKSAANSELDAYGCSDFYKRLIDKAKTVEGVEALKDAILAACP

SEQ ID NO: 1028 - protein, 46 aa, ARTIFICIAL SEQUENCE
  Engineered albumin binding polypeptide
LASAKSAANSELDAYGKSDFYKRLIDKAKTVEGVEALKDAILAAKP

SEQ ID NO: 1029 - protein, 46 aa, ARTIFICIAL SEQUENCE
  Engineered albumin binding polypeptide
LASAKEAANAELDSYGCSDFYKRLIDKAKTVEGVEALKDAILAAKP

SEQ ID NO: 1030 - protein, 46 aa, ARTIFICIAL SEQUENCE
  Engineered albumin binding polypeptide
LASAKEAANAELDSYGKSDFYKRLIDKAKTVEGVEALKDAILAACP

SEQ ID NO: 1031 - protein, 46 aa, ARTIFICIAL SEQUENCE
  Engineered albumin binding polypeptide
LASAKEAANAELDSYGCSDFYKRLIDKAKTVEGVEALKDAILAACP

SEQ ID NO: 1032 - protein, 46 aa, ARTIFICIAL SEQUENCE
  Engineered albumin binding polypeptide
LASAKEAANAELDSYGKSDFYKRLIDKAKTVEGVEALKDAILAAKP

SEQ ID NO: 1033 - protein, 46 aa, ARTIFICIAL SEQUENCE
  Engineered albumin binding polypeptide
LASAKEAANSELDSYGCSDFYKRLIDKAKTVEGVEALKDAILAAKP

SEQ ID NO: 1034 - protein, 46 aa, ARTIFICIAL SEQUENCE
  Engineered albumin binding polypeptide
LASAKEAANSELDSYGKSDFYKRLIDKAKTVEGVEALKDAILAACP

SEQ ID NO: 1035 - protein, 46 aa, ARTIFICIAL SEQUENCE
  Engineered albumin binding polypeptide
LASAKEAANSELDSYGCSDFYKRLIDKAKTVEGVEALKDAILAACP

SEQ ID NO: 1036 - protein, 46 aa, ARTIFICIAL SEQUENCE
  Engineered albumin binding polypeptide
LASAKEAANSELDSYGKSDFYKRLIDKAKTVEGVEALKDAILAAKP

SEQ ID NO: 1037 - protein, 46 aa, ARTIFICIAL SEQUENCE
  Engineered albumin binding polypeptide
LASAKESANSELDSYGCSDFYKRLIDKAKTVEGVEALKDAILAAKP

SEQ ID NO: 1038 - protein, 46 aa, ARTIFICIAL SEQUENCE
  Engineered albumin binding polypeptide
LASAKESANSELDSYGKSDFYKRLIDKAKTVEGVEALKDAILAACP

SEQ ID NO: 1039 - protein, 46 aa, ARTIFICIAL SEQUENCE
  Engineered albumin binding polypeptide
LASAKESANSELDSYGCSDFYKRLIDKAKTVEGVEALKDAILAACP

SEQ ID NO: 1040 - protein, 46 aa, ARTIFICIAL SEQUENCE
  Engineered albumin binding polypeptide
LASAKESANSELDSYGKSDFYKRLIDKAKTVEGVEALKDAILAAKP

SEQ ID NO: 1041 - protein, 46 aa, ARTIFICIAL SEQUENCE
  Engineered albumin binding polypeptide
LASAKESANAELDSYGCSDFYKRLIDKAKTVEGVEALKDAILAAKP

SEQ ID NO: 1042 - protein, 46 aa, ARTIFICIAL SEQUENCE
  Engineered albumin binding polypeptide
LASAKESANAELDSYGKSDFYKRLIDKAKTVEGVEALKDAILAACP

SEQ ID NO: 1043 - protein, 46 aa, ARTIFICIAL SEQUENCE
  Engineered albumin binding polypeptide
LASAKESANAELDSYGCSDFYKRLIDKAKTVEGVEALKDAILAACP

SEQ ID NO: 1044 - protein, 46 aa, ARTIFICIAL SEQUENCE
  Engineered albumin binding polypeptide
LASAKESANAELDSYGKSDFYKRLIDKAKTVEGVEALKDAILAAKP

SEQ ID NO: 1045 - protein, 46 aa, ARTIFICIAL SEQUENCE
  Engineered albumin binding polypeptide
LASAKSAANAELDSYGCSDFYKRLIDKAKTVEGVEALKDAILAAKP

SEQ ID NO: 1046 - protein, 46 aa, ARTIFICIAL SEQUENCE
  Engineered albumin binding polypeptide
LASAKSAANAELDSYGKSDFYKRLIDKAKTVEGVEALKDAILAACP

SEQ ID NO: 1047 - protein, 46 aa, ARTIFICIAL SEQUENCE
  Engineered albumin binding polypeptide
LASAKSAANAELDSYGCSDFYKRLIDKAKTVEGVEALKDAILAACP

SEQ ID NO: 1048 - protein, 46 aa, ARTIFICIAL SEQUENCE
  Engineered albumin binding polypeptide
LASAKSAANAELDSYGKSDFYKRLIDKAKTVEGVEALKDAILAAKP

SEQ ID NO: 1049 - protein, 46 aa, ARTIFICIAL SEQUENCE
  Engineered albumin binding polypeptide
LASAKSAANSELDSYGCSDFYKRLIDKAKTVEGVEALKDAILAAKP

SEQ ID NO: 1050 - protein, 46 aa, ARTIFICIAL SEQUENCE
  Engineered albumin binding polypeptide
LASAKSAANSELDSYGKSDFYKRLIDKAKTVEGVEALKDAILAACP

SEQ ID NO: 1051 - protein, 46 aa, ARTIFICIAL SEQUENCE
  Engineered albumin binding polypeptide
LASAKSAANSELDSYGCSDFYKRLIDKAKTVEGVEALKDAILAACP

SEQ ID NO: 1052 - protein, 46 aa, ARTIFICIAL SEQUENCE
  Engineered albumin binding polypeptide
LASAKSAANSELDSYGKSDFYKRLIDKAKTVEGVEALKDAILAAKP

SEQ ID NO: 1053 - protein, 46 aa, ARTIFICIAL SEQUENCE
  Engineered albumin binding polypeptide
LAEAKEAANSELDSYGCSDFYKRLIDKAKTVEGVEALKDAILAAKP

SEQ ID NO: 1054 - protein, 46 aa, ARTIFICIAL SEQUENCE
  Engineered albumin binding polypeptide
LAEAKEAANSELDSYGKSDFYKRLIDKAKTVEGVEALKDAILAACP

SEQ ID NO: 1055 - protein, 46 aa, ARTIFICIAL SEQUENCE
  Engineered albumin binding polypeptide
LAEAKEAANSELDSYGCSDFYKRLIDKAKTVEGVEALKDAILAACP

SEQ ID NO: 1056 - protein, 46 aa, ARTIFICIAL SEQUENCE
  Engineered albumin binding polypeptide
LAEAKEAANSELDSYGKSDFYKRLIDKAKTVEGVEALKDAILAAKP

SEQ ID NO: 1057 - protein, 46 aa, ARTIFICIAL SEQUENCE
  Engineered albumin binding polypeptide
LAEAKESANSELDSYGCSDFYKRLIDKAKTVEGVEALKDAILAAKP

SEQ ID NO: 1058 - protein, 46 aa, ARTIFICIAL SEQUENCE
  Engineered albumin binding polypeptide
LAEAKESANSELDSYGKSDFYKRLIDKAKTVEGVEALKDAILAACP

SEQ ID NO: 1059 - protein, 46 aa, ARTIFICIAL SEQUENCE
  Engineered albumin binding polypeptide
LAEAKESANSELDSYGCSDFYKRLIDKAKTVEGVEALKDAILAACP

SEQ ID NO: 1060 - protein, 46 aa, ARTIFICIAL SEQUENCE
  Engineered albumin binding polypeptide
LAEAKESANSELDSYGKSDFYKRLIDKAKTVEGVEALKDAILAAKP

SEQ ID NO: 1061 - protein, 46 aa, ARTIFICIAL SEQUENCE
  Engineered albumin binding polypeptide
LAEAKESANAELDSYGCSDFYKRLIDKAKTVEGVEALKDAILAAKP

SEQ ID NO: 1062 - protein, 46 aa, ARTIFICIAL SEQUENCE
  Engineered albumin binding polypeptide
LAEAKESANAELDSYGKSDFYKRLIDKAKTVEGVEALKDAILAACP

SEQ ID NO: 1063 - protein, 46 aa, ARTIFICIAL SEQUENCE
  Engineered albumin binding polypeptide
LAEAKESANAELDSYGCSDFYKRLIDKAKTVEGVEALKDAILAACP

SEQ ID NO: 1064 - protein, 46 aa, ARTIFICIAL SEQUENCE
  Engineered albumin binding polypeptide
LAEAKESANAELDSYGKSDFYKRLIDKAKTVEGVEALKDAILAAKP

SEQ ID NO: 1065 - protein, 46 aa, ARTIFICIAL SEQUENCE
  Engineered albumin binding polypeptide
LAEAKSAANAELDSYGCSDFYKRLIDKAKTVEGVEALKDAILAAKP

SEQ ID NO: 1066 - protein, 46 aa, ARTIFICIAL SEQUENCE
  Engineered albumin binding polypeptide
LAEAKSAANAELDSYGKSDFYKRLIDKAKTVEGVEALKDAILAACP

SEQ ID NO: 1067 - protein, 46 aa, ARTIFICIAL SEQUENCE
  Engineered albumin binding polypeptide
LAEAKSAANAELDSYGCSDFYKRLIDKAKTVEGVEALKDAILAACP

SEQ ID NO: 1068 - protein, 46 aa, ARTIFICIAL SEQUENCE
  Engineered albumin binding polypeptide
LAEAKSAANAELDSYGKSDFYKRLIDKAKTVEGVEALKDAILAAKP

SEQ ID NO: 1069 - protein, 46 aa, ARTIFICIAL SEQUENCE
  Engineered albumin binding polypeptide
LAEAKSAANSELDSYGCSDFYKRLIDKAKTVEGVEALKDAILAAKP

SEQ ID NO: 1070 - protein, 46 aa, ARTIFICIAL SEQUENCE
  Engineered albumin binding polypeptide
LAEAKSAANSELDSYGKSDFYKRLIDKAKTVEGVEALKDAILAACP

SEQ ID NO: 1071 - protein, 46 aa, ARTIFICIAL SEQUENCE
  Engineered albumin binding polypeptide
LAEAKSAANSELDSYGCSDFYKRLIDKAKTVEGVEALKDAILAACP

SEQ ID NO: 1072 - protein, 46 aa, ARTIFICIAL SEQUENCE
  Engineered albumin binding polypeptide
LAEAKSAANSELDSYGKSDFYKRLIDKAKTVEGVEALKDAILAAKP

SEQ ID NO: 1073 - protein, 46 aa, ARTIFICIAL SEQUENCE
  Engineered albumin binding polypeptide
LAEAKEAANAELDAYGCSDFYKRLIDKAKTVEGVEALKDAILAAKP

SEQ ID NO: 1074 - protein, 46 aa, ARTIFICIAL SEQUENCE
  Engineered albumin binding polypeptide
LAEAKEAANAELDAYGKSDFYKRLIDKAKTVEGVEALKDAILAACP

SEQ ID NO: 1075 - protein, 46 aa, ARTIFICIAL SEQUENCE
  Engineered albumin binding polypeptide
LAEAKEAANAELDAYGCSDFYKRLIDKAKTVEGVEALKDAILAACP

SEQ ID NO: 1076 - protein, 46 aa, ARTIFICIAL SEQUENCE
  Engineered albumin binding polypeptide
LAEAKEAANAELDAYGKSDFYKRLIDKAKTVEGVEALKDAILAAKP

SEQ ID NO: 1077 - protein, 46 aa, ARTIFICIAL SEQUENCE
  Engineered albumin binding polypeptide
LAEAKEAANSELDAYGCSDFYKRLIDKAKTVEGVEALKDAILAAKP

SEQ ID NO: 1078 - protein, 46 aa, ARTIFICIAL SEQUENCE
  Engineered albumin binding polypeptide
LAEAKEAANSELDAYGKSDFYKRLIDKAKTVEGVEALKDAILAACP

SEQ ID NO: 1079 - protein, 46 aa, ARTIFICIAL SEQUENCE
  Engineered albumin binding polypeptide
LAEAKEAANSELDAYGCSDFYKRLIDKAKTVEGVEALKDAILAACP

SEQ ID NO: 1080 - protein, 46 aa, ARTIFICIAL SEQUENCE
  Engineered albumin binding polypeptide
LAEAKEAANSELDAYGKSDFYKRLIDKAKTVEGVEALKDAILAAKP

SEQ ID NO: 1081 - protein, 46 aa, ARTIFICIAL SEQUENCE
  Engineered albumin binding polypeptide
LAEAKESANSELDAYGCSDFYKRLIDKAKTVEGVEALKDAILAAKP

SEQ ID NO: 1082 - protein, 46 aa, ARTIFICIAL SEQUENCE
  Engineered albumin binding polypeptide
LAEAKESANSELDAYGKSDFYKRLIDKAKTVEGVEALKDAILAACP

SEQ ID NO: 1083 - protein, 46 aa, ARTIFICIAL SEQUENCE
  Engineered albumin binding polypeptide
LAEAKESANSELDAYGCSDFYKRLIDKAKTVEGVEALKDAILAACP

SEQ ID NO: 1084 - protein, 46 aa, ARTIFICIAL SEQUENCE
  Engineered albumin binding polypeptide
LAEAKESANSELDAYGKSDFYKRLIDKAKTVEGVEALKDAILAAKP

SEQ ID NO: 1085 - protein, 46 aa, ARTIFICIAL SEQUENCE
  Engineered albumin binding polypeptide
LAEAKESANAELDAYGCSDFYKRLIDKAKTVEGVEALKDAILAAKP

SEQ ID NO: 1086 - protein, 46 aa, ARTIFICIAL SEQUENCE
  Engineered albumin binding polypeptide
LAEAKESANAELDAYGKSDFYKRLIDKAKTVEGVEALKDAILAACP

SEQ ID NO: 1087 - protein, 46 aa, ARTIFICIAL SEQUENCE
  Engineered albumin binding polypeptide
LAEAKESANAELDAYGCSDFYKRLIDKAKTVEGVEALKDAILAACP

SEQ ID NO: 1088 - protein, 46 aa, ARTIFICIAL SEQUENCE
  Engineered albumin binding polypeptide
LAEAKESANAELDAYGKSDFYKRLIDKAKTVEGVEALKDAILAAKP

SEQ ID NO: 1089 - protein, 46 aa, ARTIFICIAL SEQUENCE
  Engineered albumin binding polypeptide
LAEAKSAANAELDAYGCSDFYKRLIDKAKTVEGVEALKDAILAAKP

SEQ ID NO: 1090 - protein, 46 aa, ARTIFICIAL SEQUENCE
  Engineered albumin binding polypeptide
LAEAKSAANAELDAYGKSDFYKRLIDKAKTVEGVEALKDAILAACP

SEQ ID NO: 1091 - protein, 46 aa, ARTIFICIAL SEQUENCE
  Engineered albumin binding polypeptide
LAEAKSAANAELDAYGCSDFYKRLIDKAKTVEGVEALKDAILAACP

SEQ ID NO: 1092 - protein, 46 aa, ARTIFICIAL SEQUENCE
  Engineered albumin binding polypeptide
LAEAKSAANAELDAYGKSDFYKRLIDKAKTVEGVEALKDAILAAKP

SEQ ID NO: 1093 - protein, 46 aa, ARTIFICIAL SEQUENCE
  Engineered albumin binding polypeptide
LAEAKSAANSELDAYGCSDFYKRLIDKAKTVEGVEALKDAILAAKP

SEQ ID NO: 1094 - protein, 46 aa, ARTIFICIAL SEQUENCE
  Engineered albumin binding polypeptide
LAEAKSAANSELDAYGKSDFYKRLIDKAKTVEGVEALKDAILAACP

SEQ ID NO: 1095 - protein, 46 aa, ARTIFICIAL SEQUENCE
  Engineered albumin binding polypeptide
LAEAKSAANSELDAYGCSDFYKRLIDKAKTVEGVEALKDAILAACP

SEQ ID NO: 1096 - protein, 46 aa, ARTIFICIAL SEQUENCE
  Engineered albumin binding polypeptide
LAEAKSAANSELDAYGKSDFYKRLIDKAKTVEGVEALKDAILAAKP

SEQ ID NO: 1097 - protein, 46 aa, ARTIFICIAL SEQUENCE
  Engineered albumin binding polypeptide
LAQAKEAANAELDAYGCSDFYKRLIDKAKTVEGVEALKDAILAAKP

SEQ ID NO: 1098 - protein, 46 aa, ARTIFICIAL SEQUENCE
  Engineered albumin binding polypeptide
LAQAKEAANAELDAYGKSDFYKRLIDKAKTVEGVEALKDAILAACP

SEQ ID NO: 1099 - protein, 46 aa, ARTIFICIAL SEQUENCE
  Engineered albumin binding polypeptide
LAQAKEAANAELDAYGCSDFYKRLIDKAKTVEGVEALKDAILAACP

SEQ ID NO: 1100 - protein, 46 aa, ARTIFICIAL SEQUENCE
  Engineered albumin binding polypeptide
LAQAKEAANAELDAYGKSDFYKRLIDKAKTVEGVEALKDAILAAKP

SEQ ID NO: 1101 - protein, 46 aa, ARTIFICIAL SEQUENCE
  Engineered albumin binding polypeptide
LAQAKEAANSELDAYGCSDFYKRLIDKAKTVEGVEALKDAILAAKP

SEQ ID NO: 1102 - protein, 46 aa, ARTIFICIAL SEQUENCE
  Engineered albumin binding polypeptide
LAQAKEAANSELDAYGKSDFYKRLIDKAKTVEGVEALKDAILAACP

SEQ ID NO: 1103 - protein, 46 aa, ARTIFICIAL SEQUENCE
  Engineered albumin binding polypeptide
LAQAKEAANSELDAYGCSDFYKRLIDKAKTVEGVEALKDAILAACP

SEQ ID NO: 1104 - protein, 46 aa, ARTIFICIAL SEQUENCE
  Engineered albumin binding polypeptide
LAQAKEAANSELDAYGKSDFYKRLIDKAKTVEGVEALKDAILAAKP

SEQ ID NO: 1105 - protein, 46 aa, ARTIFICIAL SEQUENCE
  Engineered albumin binding polypeptide
LAQAKESANSELDAYGCSDFYKRLIDKAKTVEGVEALKDAILAAKP

SEQ ID NO: 1106 - protein, 46 aa, ARTIFICIAL SEQUENCE
  Engineered albumin binding polypeptide
LAQAKESANSELDAYGKSDFYKRLIDKAKTVEGVEALKDAILAACP

SEQ ID NO: 1107 - protein, 46 aa, ARTIFICIAL SEQUENCE
  Engineered albumin binding polypeptide
LAQAKESANSELDAYGCSDFYKRLIDKAKTVEGVEALKDAILAACP

SEQ ID NO: 1108 - protein, 46 aa, ARTIFICIAL SEQUENCE
  Engineered albumin binding polypeptide
LAQAKESANSELDAYGKSDFYKRLIDKAKTVEGVEALKDAILAAKP

SEQ ID NO: 1109 - protein, 46 aa, ARTIFICIAL SEQUENCE
  Engineered albumin binding polypeptide
LAQAKESANAELDAYGCSDFYKRLIDKAKTVEGVEALKDAILAAKP

SEQ ID NO: 1110 - protein, 46 aa, ARTIFICIAL SEQUENCE
  Engineered albumin binding polypeptide
LAQAKESANAELDAYGKSDFYKRLIDKAKTVEGVEALKDAILAACP

SEQ ID NO: 1111 - protein, 46 aa, ARTIFICIAL SEQUENCE
  Engineered albumin binding polypeptide
LAQAKESANAELDAYGCSDFYKRLIDKAKTVEGVEALKDAILAACP

SEQ ID NO: 1112 - protein, 46 aa, ARTIFICIAL SEQUENCE
  Engineered albumin binding polypeptide
LAQAKESANAELDAYGKSDFYKRLIDKAKTVEGVEALKDAILAAKP

SEQ ID NO: 1113 - protein, 46 aa, ARTIFICIAL SEQUENCE
  Engineered albumin binding polypeptide
LAQAKSAANAELDAYGCSDFYKRLIDKAKTVEGVEALKDAILAAKP

SEQ ID NO: 1114 - protein, 46 aa, ARTIFICIAL SEQUENCE
  Engineered albumin binding polypeptide
LAQAKSAANAELDAYGKSDFYKRLIDKAKTVEGVEALKDAILAACP

SEQ ID NO: 1115 - protein, 46 aa, ARTIFICIAL SEQUENCE
  Engineered albumin binding polypeptide
LAQAKSAANAELDAYGCSDFYKRLIDKAKTVEGVEALKDAILAACP

SEQ ID NO: 1116 - protein, 46 aa, ARTIFICIAL SEQUENCE
  Engineered albumin binding polypeptide
LAQAKSAANAELDAYGKSDFYKRLIDKAKTVEGVEALKDAILAAKP

SEQ ID NO: 1117 - protein, 46 aa, ARTIFICIAL SEQUENCE
  Engineered albumin binding polypeptide
LAQAKSAANSELDAYGCSDFYKRLIDKAKTVEGVEALKDAILAAKP

SEQ ID NO: 1118 - protein, 46 aa, ARTIFICIAL SEQUENCE
  Engineered albumin binding polypeptide
LAQAKSAANSELDAYGKSDFYKRLIDKAKTVEGVEALKDAILAACP

SEQ ID NO: 1119 - protein, 46 aa, ARTIFICIAL SEQUENCE
  Engineered albumin binding polypeptide
LAQAKSAANSELDAYGCSDFYKRLIDKAKTVEGVEALKDAILAACP

SEQ ID NO: 1120 - protein, 46 aa, ARTIFICIAL SEQUENCE
  Engineered albumin binding polypeptide
LAQAKSAANSELDAYGKSDFYKRLIDKAKTVEGVEALKDAILAAKP

SEQ ID NO: 1121 - protein, 46 aa, ARTIFICIAL SEQUENCE
  Engineered albumin binding polypeptide
LAQAKEAANAELDSYGCSDFYKRLIDKAKTVEGVEALKDAILAAKP

SEQ ID NO: 1122 - protein, 46 aa, ARTIFICIAL SEQUENCE
  Engineered albumin binding polypeptide
LAQAKEAANAELDSYGKSDFYKRLIDKAKTVEGVEALKDAILAACP

SEQ ID NO: 1123 - protein, 46 aa, ARTIFICIAL SEQUENCE
  Engineered albumin binding polypeptide
LAQAKEAANAELDSYGCSDFYKRLIDKAKTVEGVEALKDAILAACP

SEQ ID NO: 1124 - protein, 46 aa, ARTIFICIAL SEQUENCE
  Engineered albumin binding polypeptide
LAQAKEAANAELDSYGKSDFYKRLIDKAKTVEGVEALKDAILAAKP

SEQ ID NO: 1125 - protein, 46 aa, ARTIFICIAL SEQUENCE
  Engineered albumin binding polypeptide
LAQAKEAANSELDSYGCSDFYKRLIDKAKTVEGVEALKDAILAAKP

SEQ ID NO: 1126 - protein, 46 aa, ARTIFICIAL SEQUENCE
  Engineered albumin binding polypeptide
LAQAKEAANSELDSYGKSDFYKRLIDKAKTVEGVEALKDAILAACP

SEQ ID NO: 1127 - protein, 46 aa, ARTIFICIAL SEQUENCE
  Engineered albumin binding polypeptide
LAQAKEAANSELDSYGCSDFYKRLIDKAKTVEGVEALKDAILAACP

SEQ ID NO: 1128 - protein, 46 aa, ARTIFICIAL SEQUENCE
  Engineered albumin binding polypeptide
LAQAKEAANSELDSYGKSDFYKRLIDKAKTVEGVEALKDAILAAKP

SEQ ID NO: 1129 - protein, 46 aa, ARTIFICIAL SEQUENCE
  Engineered albumin binding polypeptide
LAQAKESANSELDSYGCSDFYKRLIDKAKTVEGVEALKDAILAAKP

SEQ ID NO: 1130 - protein, 46 aa, ARTIFICIAL SEQUENCE
  Engineered albumin binding polypeptide
LAQAKESANSELDSYGKSDFYKRLIDKAKTVEGVEALKDAILAACP

SEQ ID NO: 1131 - protein, 46 aa, ARTIFICIAL SEQUENCE
  Engineered albumin binding polypeptide
LAQAKESANSELDSYGCSDFYKRLIDKAKTVEGVEALKDAILAACP

SEQ ID NO: 1132 - protein, 46 aa, ARTIFICIAL SEQUENCE
  Engineered albumin binding polypeptide
LAQAKESANSELDSYGKSDFYKRLIDKAKTVEGVEALKDAILAAKP

SEQ ID NO: 1133 - protein, 46 aa, ARTIFICIAL SEQUENCE
  Engineered albumin binding polypeptide
LAQAKESANAELDSYGCSDFYKRLIDKAKTVEGVEALKDAILAAKP

SEQ ID NO: 1134 - protein, 46 aa, ARTIFICIAL SEQUENCE
  Engineered albumin binding polypeptide
LAQAKESANAELDSYGKSDFYKRLIDKAKTVEGVEALKDAILAACP

SEQ ID NO: 1135 - protein, 46 aa, ARTIFICIAL SEQUENCE
  Engineered albumin binding polypeptide
LAQAKESANAELDSYGCSDFYKRLIDKAKTVEGVEALKDAILAACP

SEQ ID NO: 1136 - protein, 46 aa, ARTIFICIAL SEQUENCE
  Engineered albumin binding polypeptide
LAQAKESANAELDSYGKSDFYKRLIDKAKTVEGVEALKDAILAAKP

SEQ ID NO: 1137 - protein, 46 aa, ARTIFICIAL SEQUENCE
  Engineered albumin binding polypeptide
LAQAKSAANAELDSYGCSDFYKRLIDKAKTVEGVEALKDAILAAKP

SEQ ID NO: 1138 - protein, 46 aa, ARTIFICIAL SEQUENCE
  Engineered albumin binding polypeptide
LAQAKSAANAELDSYGKSDFYKRLIDKAKTVEGVEALKDAILAACP

SEQ ID NO: 1139 - protein, 46 aa, ARTIFICIAL SEQUENCE
  Engineered albumin binding polypeptide
LAQAKSAANAELDSYGCSDFYKRLIDKAKTVEGVEALKDAILAACP

SEQ ID NO: 1140 - protein, 46 aa, ARTIFICIAL SEQUENCE
  Engineered albumin binding polypeptide
LAQAKSAANAELDSYGKSDFYKRLIDKAKTVEGVEALKDAILAAKP

SEQ ID NO: 1141 - protein, 46 aa, ARTIFICIAL SEQUENCE
  Engineered albumin binding polypeptide
LAQAKSAANSELDSYGCSDFYKRLIDKAKTVEGVEALKDAILAAKP

SEQ ID NO: 1142 - protein, 46 aa, ARTIFICIAL SEQUENCE
  Engineered albumin binding polypeptide
LAQAKSAANSELDSYGKSDFYKRLIDKAKTVEGVEALKDAILAACP

SEQ ID NO: 1143 - protein, 46 aa, ARTIFICIAL SEQUENCE
  Engineered albumin binding polypeptide
LAQAKSAANSELDSYGCSDFYKRLIDKAKTVEGVEALKDAILAACP

SEQ ID NO: 1144 - protein, 46 aa, ARTIFICIAL SEQUENCE
  Engineered albumin binding polypeptide
LAQAKSAANSELDSYGKSDFYKRLIDKAKTVEGVEALKDAILAAKP

SEQ ID NO: 1145 - protein, 46 aa, ARTIFICIAL SEQUENCE
  Engineered albumin binding polypeptide
LASAKEAANAELDCYGCSDFYKRLIDKAKTVEGVEALKDAILAAKP

SEQ ID NO: 1146 - protein, 46 aa, ARTIFICIAL SEQUENCE
  Engineered albumin binding polypeptide
LASAKEAANAELDCYGKSDFYKRLIDKAKTVEGVEALKDAILAACP

SEQ ID NO: 1147 - protein, 46 aa, ARTIFICIAL SEQUENCE
  Engineered albumin binding polypeptide
LASAKEAANAELDCYGCSDFYKRLIDKAKTVEGVEALKDAILAACP

SEQ ID NO: 1148 - protein, 46 aa, ARTIFICIAL SEQUENCE
  Engineered albumin binding polypeptide
LASAKEAANAELDCYGKSDFYKRLIDKAKTVEGVEALKDAILAAKP

SEQ ID NO: 1149 - protein, 46 aa, ARTIFICIAL SEQUENCE
  Engineered albumin binding polypeptide
LASAKEAANSELDCYGCSDFYKRLIDKAKTVEGVEALKDAILAAKP

SEQ ID NO: 1150 - protein, 46 aa, ARTIFICIAL SEQUENCE
  Engineered albumin binding polypeptide
LASAKEAANSELDCYGKSDFYKRLIDKAKTVEGVEALKDAILAACP

SEQ ID NO: 1151 - protein, 46 aa, ARTIFICIAL SEQUENCE
  Engineered albumin binding polypeptide
LASAKEAANSELDCYGCSDFYKRLIDKAKTVEGVEALKDAILAACP

SEQ ID NO: 1152 - protein, 46 aa, ARTIFICIAL SEQUENCE
  Engineered albumin binding polypeptide
LASAKEAANSELDCYGKSDFYKRLIDKAKTVEGVEALKDAILAAKP

SEQ ID NO: 1153 - protein, 46 aa, ARTIFICIAL SEQUENCE
  Engineered albumin binding polypeptide
LASAKESANSELDCYGCSDFYKRLIDKAKTVEGVEALKDAILAAKP

SEQ ID NO: 1154 - protein, 46 aa, ARTIFICIAL SEQUENCE
  Engineered albumin binding polypeptide
LASAKESANSELDCYGKSDFYKRLIDKAKTVEGVEALKDAILAACP

SEQ ID NO: 1155 - protein, 46 aa, ARTIFICIAL SEQUENCE
  Engineered albumin binding polypeptide
LASAKESANSELDCYGCSDFYKRLIDKAKTVEGVEALKDAILAACP

SEQ ID NO: 1156 - protein, 46 aa, ARTIFICIAL SEQUENCE
  Engineered albumin binding polypeptide
LASAKESANSELDCYGKSDFYKRLIDKAKTVEGVEALKDAILAAKP

SEQ ID NO: 1157 - protein, 46 aa, ARTIFICIAL SEQUENCE
  Engineered albumin binding polypeptide
LASAKESANAELDCYGCSDFYKRLIDKAKTVEGVEALKDAILAAKP

SEQ ID NO: 1158 - protein, 46 aa, ARTIFICIAL SEQUENCE
  Engineered albumin binding polypeptide
LASAKESANAELDCYGKSDFYKRLIDKAKTVEGVEALKDAILAACP

SEQ ID NO: 1159 - protein, 46 aa, ARTIFICIAL SEQUENCE
  Engineered albumin binding polypeptide
LASAKESANAELDCYGCSDFYKRLIDKAKTVEGVEALKDAILAACP

SEQ ID NO: 1160 - protein, 46 aa, ARTIFICIAL SEQUENCE
  Engineered albumin binding polypeptide
LASAKESANAELDCYGKSDFYKRLIDKAKTVEGVEALKDAILAAKP

SEQ ID NO: 1161 - protein, 46 aa, ARTIFICIAL SEQUENCE
  Engineered albumin binding polypeptide
LASAKSAANAELDCYGCSDFYKRLIDKAKTVEGVEALKDAILAAKP

SEQ ID NO: 1162 - protein, 46 aa, ARTIFICIAL SEQUENCE
  Engineered albumin binding polypeptide
LASAKSAANAELDCYGKSDFYKRLIDKAKTVEGVEALKDAILAACP

SEQ ID NO: 1163 - protein, 46 aa, ARTIFICIAL SEQUENCE
  Engineered albumin binding polypeptide
LASAKSAANAELDCYGCSDFYKRLIDKAKTVEGVEALKDAILAACP

SEQ ID NO: 1164 - protein, 46 aa, ARTIFICIAL SEQUENCE
  Engineered albumin binding polypeptide
LASAKSAANAELDCYGKSDFYKRLIDKAKTVEGVEALKDAILAAKP

SEQ ID NO: 1165 - protein, 46 aa, ARTIFICIAL SEQUENCE
  Engineered albumin binding polypeptide
LASAKSAANSELDCYGCSDFYKRLIDKAKTVEGVEALKDAILAAKP

SEQ ID NO: 1166 - protein, 46 aa, ARTIFICIAL SEQUENCE
  Engineered albumin binding polypeptide
LASAKSAANSELDCYGKSDFYKRLIDKAKTVEGVEALKDAILAACP

SEQ ID NO: 1167 - protein, 46 aa, ARTIFICIAL SEQUENCE
  Engineered albumin binding polypeptide
LASAKSAANSELDCYGCSDFYKRLIDKAKTVEGVEALKDAILAACP

SEQ ID NO: 1168 - protein, 46 aa, ARTIFICIAL SEQUENCE
  Engineered albumin binding polypeptide
LASAKSAANSELDCYGKSDFYKRLIDKAKTVEGVEALKDAILAAKP

SEQ ID NO: 1169 - protein, 46 aa, ARTIFICIAL SEQUENCE
  Engineered albumin binding polypeptide
LASAKEAANAELDKYGCSDFYKRLIDKAKTVEGVEALKDAILAAKP

SEQ ID NO: 1170 - protein, 46 aa, ARTIFICIAL SEQUENCE
  Engineered albumin binding polypeptide
LASAKEAANAELDKYGKSDFYKRLIDKAKTVEGVEALKDAILAACP

SEQ ID NO: 1171 - protein, 46 aa, ARTIFICIAL SEQUENCE
  Engineered albumin binding polypeptide
LASAKEAANAELDKYGCSDFYKRLIDKAKTVEGVEALKDAILAACP

SEQ ID NO: 1172 - protein, 46 aa, ARTIFICIAL SEQUENCE
  Engineered albumin binding polypeptide
LASAKEAANAELDKYGKSDFYKRLIDKAKTVEGVEALKDAILAAKP

SEQ ID NO: 1173 - protein, 46 aa, ARTIFICIAL SEQUENCE
  Engineered albumin binding polypeptide
LASAKEAANSELDKYGCSDFYKRLIDKAKTVEGVEALKDAILAAKP

SEQ ID NO: 1174 - protein, 46 aa, ARTIFICIAL SEQUENCE
  Engineered albumin binding polypeptide
LASAKEAANSELDKYGKSDFYKRLIDKAKTVEGVEALKDAILAACP

SEQ ID NO: 1175 - protein, 46 aa, ARTIFICIAL SEQUENCE
  Engineered albumin binding polypeptide
LASAKEAANSELDKYGCSDFYKRLIDKAKTVEGVEALKDAILAACP

SEQ ID NO: 1176 - protein, 46 aa, ARTIFICIAL SEQUENCE
  Engineered albumin binding polypeptide
LASAKEAANSELDKYGKSDFYKRLIDKAKTVEGVEALKDAILAAKP

SEQ ID NO: 1177 - protein, 46 aa, ARTIFICIAL SEQUENCE
  Engineered albumin binding polypeptide
LASAKESANSELDKYGCSDFYKRLIDKAKTVEGVEALKDAILAAKP

SEQ ID NO: 1178 - protein, 46 aa, ARTIFICIAL SEQUENCE
  Engineered albumin binding polypeptide
LASAKESANSELDKYGKSDFYKRLIDKAKTVEGVEALKDAILAACP

SEQ ID NO: 1179 - protein, 46 aa, ARTIFICIAL SEQUENCE
  Engineered albumin binding polypeptide
LASAKESANSELDKYGCSDFYKRLIDKAKTVEGVEALKDAILAACP

SEQ ID NO: 1180 - protein, 46 aa, ARTIFICIAL SEQUENCE
  Engineered albumin binding polypeptide
LASAKESANSELDKYGKSDFYKRLIDKAKTVEGVEALKDAILAAKP

SEQ ID NO: 1181 - protein, 46 aa, ARTIFICIAL SEQUENCE
  Engineered albumin binding polypeptide
LASAKESANAELDKYGCSDFYKRLIDKAKTVEGVEALKDAILAAKP

SEQ ID NO: 1182 - protein, 46 aa, ARTIFICIAL SEQUENCE
  Engineered albumin binding polypeptide
LASAKESANAELDKYGKSDFYKRLIDKAKTVEGVEALKDAILAACP

SEQ ID NO: 1183 - protein, 46 aa, ARTIFICIAL SEQUENCE
  Engineered albumin binding polypeptide
LASAKESANAELDKYGCSDFYKRLIDKAKTVEGVEALKDAILAACP

SEQ ID NO: 1184 - protein, 46 aa, ARTIFICIAL SEQUENCE
  Engineered albumin binding polypeptide
LASAKESANAELDKYGKSDFYKRLIDKAKTVEGVEALKDAILAAKP

SEQ ID NO: 1185 - protein, 46 aa, ARTIFICIAL SEQUENCE
  Engineered albumin binding polypeptide
LASAKSAANAELDKYGCSDFYKRLIDKAKTVEGVEALKDAILAAKP

SEQ ID NO: 1186 - protein, 46 aa, ARTIFICIAL SEQUENCE
  Engineered albumin binding polypeptide
LASAKSAANAELDKYGKSDFYKRLIDKAKTVEGVEALKDAILAACP

SEQ ID NO: 1187 - protein, 46 aa, ARTIFICIAL SEQUENCE
  Engineered albumin binding polypeptide
LASAKSAANAELDKYGCSDFYKRLIDKAKTVEGVEALKDAILAACP

SEQ ID NO: 1188 - protein, 46 aa, ARTIFICIAL SEQUENCE
  Engineered albumin binding polypeptide
LASAKSAANAELDKYGKSDFYKRLIDKAKTVEGVEALKDAILAAKP

SEQ ID NO: 1189 - protein, 46 aa, ARTIFICIAL SEQUENCE
  Engineered albumin binding polypeptide
LASAKSAANSELDKYGCSDFYKRLIDKAKTVEGVEALKDAILAAKP

SEQ ID NO: 1190 - protein, 46 aa, ARTIFICIAL SEQUENCE
  Engineered albumin binding polypeptide
LASAKSAANSELDKYGKSDFYKRLIDKAKTVEGVEALKDAILAACP

SEQ ID NO: 1191 - protein, 46 aa, ARTIFICIAL SEQUENCE
  Engineered albumin binding polypeptide
LASAKSAANSELDKYGCSDFYKRLIDKAKTVEGVEALKDAILAACP

SEQ ID NO: 1192 - protein, 46 aa, ARTIFICIAL SEQUENCE
  Engineered albumin binding polypeptide
LASAKSAANSELDKYGKSDFYKRLIDKAKTVEGVEALKDAILAAKP

SEQ ID NO: 1193 - protein, 46 aa, ARTIFICIAL SEQUENCE
  Engineered albumin binding polypeptide
LAEAKEAANAELDCYGCSDFYKRLIDKAKTVEGVEALKDAILAAKP

SEQ ID NO: 1194 - protein, 46 aa, ARTIFICIAL SEQUENCE
  Engineered albumin binding polypeptide
LAEAKEAANAELDCYGKSDFYKRLIDKAKTVEGVEALKDAILAACP

SEQ ID NO: 1195 - protein, 46 aa, ARTIFICIAL SEQUENCE
  Engineered albumin binding polypeptide
LAEAKEAANAELDCYGCSDFYKRLIDKAKTVEGVEALKDAILAACP

SEQ ID NO: 1196 - protein, 46 aa, ARTIFICIAL SEQUENCE
  Engineered albumin binding polypeptide
LAEAKEAANAELDCYGKSDFYKRLIDKAKTVEGVEALKDAILAAKP

SEQ ID NO: 1197 - protein, 46 aa, ARTIFICIAL SEQUENCE
  Engineered albumin binding polypeptide
LAEAKEAANSELDCYGCSDFYKRLIDKAKTVEGVEALKDAILAAKP

SEQ ID NO: 1198 - protein, 46 aa, ARTIFICIAL SEQUENCE
  Engineered albumin binding polypeptide
LAEAKEAANSELDCYGKSDFYKRLIDKAKTVEGVEALKDAILAACP

SEQ ID NO: 1199 - protein, 46 aa, ARTIFICIAL SEQUENCE
  Engineered albumin binding polypeptide
LAEAKEAANSELDCYGCSDFYKRLIDKAKTVEGVEALKDAILAACP

SEQ ID NO: 1200 - protein, 46 aa, ARTIFICIAL SEQUENCE
  Engineered albumin binding polypeptide
LAEAKEAANSELDCYGKSDFYKRLIDKAKTVEGVEALKDAILAAKP

SEQ ID NO: 1201 - protein, 46 aa, ARTIFICIAL SEQUENCE
  Engineered albumin binding polypeptide
LAEAKESANSELDCYGCSDFYKRLIDKAKTVEGVEALKDAILAAKP

SEQ ID NO: 1202 - protein, 46 aa, ARTIFICIAL SEQUENCE
  Engineered albumin binding polypeptide
LAEAKESANSELDCYGKSDFYKRLIDKAKTVEGVEALKDAILAACP

SEQ ID NO: 1203 - protein, 46 aa, ARTIFICIAL SEQUENCE
  Engineered albumin binding polypeptide
LAEAKESANSELDCYGCSDFYKRLIDKAKTVEGVEALKDAILAACP

SEQ ID NO: 1204 - protein, 46 aa, ARTIFICIAL SEQUENCE
  Engineered albumin binding polypeptide
LAEAKESANSELDCYGKSDFYKRLIDKAKTVEGVEALKDAILAAKP

SEQ ID NO: 1205 - protein, 46 aa, ARTIFICIAL SEQUENCE
  Engineered albumin binding polypeptide
LAEAKESANAELDCYGCSDFYKRLIDKAKTVEGVEALKDAILAAKP

SEQ ID NO: 1206 - protein, 46 aa, ARTIFICIAL SEQUENCE
  Engineered albumin binding polypeptide
LAEAKESANAELDCYGKSDFYKRLIDKAKTVEGVEALKDAILAACP

SEQ ID NO: 1207 - protein, 46 aa, ARTIFICIAL SEQUENCE
  Engineered albumin binding polypeptide
LAEAKESANAELDCYGCSDFYKRLIDKAKTVEGVEALKDAILAACP

SEQ ID NO: 1208 - protein, 46 aa, ARTIFICIAL SEQUENCE
  Engineered albumin binding polypeptide
LAEAKESANAELDCYGKSDFYKRLIDKAKTVEGVEALKDAILAAKP

SEQ ID NO: 1209 - protein, 46 aa, ARTIFICIAL SEQUENCE
  Engineered albumin binding polypeptide
LAEAKSAANAELDCYGCSDFYKRLIDKAKTVEGVEALKDAILAAKP

SEQ ID NO: 1210 - protein, 46 aa, ARTIFICIAL SEQUENCE
  Engineered albumin binding polypeptide
LAEAKSAANAELDCYGKSDFYKRLIDKAKTVEGVEALKDAILAACP

SEQ ID NO: 1211 - protein, 46 aa, ARTIFICIAL SEQUENCE
  Engineered albumin binding polypeptide
LAEAKSAANAELDCYGCSDFYKRLIDKAKTVEGVEALKDAILAACP

SEQ ID NO: 1212 - protein, 46 aa, ARTIFICIAL SEQUENCE
  Engineered albumin binding polypeptide
LAEAKSAANAELDCYGKSDFYKRLIDKAKTVEGVEALKDAILAAKP

SEQ ID NO: 1213 - protein, 46 aa, ARTIFICIAL SEQUENCE
  Engineered albumin binding polypeptide
LAEAKSAANSELDCYGCSDFYKRLIDKAKTVEGVEALKDAILAAKP

SEQ ID NO: 1214 - protein, 46 aa, ARTIFICIAL SEQUENCE
  Engineered albumin binding polypeptide
LAEAKSAANSELDCYGKSDFYKRLIDKAKTVEGVEALKDAILAACP

SEQ ID NO: 1215 - protein, 46 aa, ARTIFICIAL SEQUENCE
  Engineered albumin binding polypeptide
LAEAKSAANSELDCYGCSDFYKRLIDKAKTVEGVEALKDAILAACP

SEQ ID NO: 1216 - protein, 46 aa, ARTIFICIAL SEQUENCE
  Engineered albumin binding polypeptide
LAEAKSAANSELDCYGKSDFYKRLIDKAKTVEGVEALKDAILAAKP

SEQ ID NO: 1217 - protein, 46 aa, ARTIFICIAL SEQUENCE
  Engineered albumin binding polypeptide
LAEAKEAANAELDKYGCSDFYKRLIDKAKTVEGVEALKDAILAAKP

SEQ ID NO: 1218 - protein, 46 aa, ARTIFICIAL SEQUENCE
  Engineered albumin binding polypeptide
LAEAKEAANAELDKYGKSDFYKRLIDKAKTVEGVEALKDAILAACP

SEQ ID NO: 1219 - protein, 46 aa, ARTIFICIAL SEQUENCE
  Engineered albumin binding polypeptide
LAEAKEAANAELDKYGCSDFYKRLIDKAKTVEGVEALKDAILAACP

SEQ ID NO: 1220 - protein, 46 aa, ARTIFICIAL SEQUENCE
  Engineered albumin binding polypeptide
LAEAKEAANAELDKYGKSDFYKRLIDKAKTVEGVEALKDAILAAKP

SEQ ID NO: 1221 - protein, 46 aa, ARTIFICIAL SEQUENCE
  Engineered albumin binding polypeptide
LAEAKEAANSELDKYGCSDFYKRLIDKAKTVEGVEALKDAILAAKP

SEQ ID NO: 1222 - protein, 46 aa, ARTIFICIAL SEQUENCE
  Engineered albumin binding polypeptide
LAEAKEAANSELDKYGKSDFYKRLIDKAKTVEGVEALKDAILAACP

SEQ ID NO: 1223 - protein, 46 aa, ARTIFICIAL SEQUENCE
  Engineered albumin binding polypeptide
LAEAKEAANSELDKYGCSDFYKRLIDKAKTVEGVEALKDAILAACP

SEQ ID NO: 1224 - protein, 46 aa, ARTIFICIAL SEQUENCE
  Engineered albumin binding polypeptide
LAEAKEAANSELDKYGKSDFYKRLIDKAKTVEGVEALKDAILAAKP

SEQ ID NO: 1225 - protein, 46 aa, ARTIFICIAL SEQUENCE
  Engineered albumin binding polypeptide
LAEAKESANSELDKYGCSDFYKRLIDKAKTVEGVEALKDAILAAKP

SEQ ID NO: 1226 - protein, 46 aa, ARTIFICIAL SEQUENCE
  Engineered albumin binding polypeptide
LAEAKESANSELDKYGKSDFYKRLIDKAKTVEGVEALKDAILAACP

SEQ ID NO: 1227 - protein, 46 aa, ARTIFICIAL SEQUENCE
  Engineered albumin binding polypeptide
LAEAKESANSELDKYGCSDFYKRLIDKAKTVEGVEALKDAILAACP

SEQ ID NO: 1228 - protein, 46 aa, ARTIFICIAL SEQUENCE
  Engineered albumin binding polypeptide
LAEAKESANSELDKYGKSDFYKRLIDKAKTVEGVEALKDAILAAKP

SEQ ID NO: 1229 - protein, 46 aa, ARTIFICIAL SEQUENCE
  Engineered albumin binding polypeptide
LAEAKESANAELDKYGCSDFYKRLIDKAKTVEGVEALKDAILAAKP

SEQ ID NO: 1230 - protein, 46 aa, ARTIFICIAL SEQUENCE
  Engineered albumin binding polypeptide
LAEAKESANAELDKYGKSDFYKRLIDKAKTVEGVEALKDAILAACP

SEQ ID NO: 1231 - protein, 46 aa, ARTIFICIAL SEQUENCE
  Engineered albumin binding polypeptide
LAEAKESANAELDKYGCSDFYKRLIDKAKTVEGVEALKDAILAACP

SEQ ID NO: 1232 - protein, 46 aa, ARTIFICIAL SEQUENCE
  Engineered albumin binding polypeptide
LAEAKESANAELDKYGKSDFYKRLIDKAKTVEGVEALKDAILAAKP

SEQ ID NO: 1233 - protein, 46 aa, ARTIFICIAL SEQUENCE
  Engineered albumin binding polypeptide
LAEAKSAANAELDKYGCSDFYKRLIDKAKTVEGVEALKDAILAAKP

SEQ ID NO: 1234 - protein, 46 aa, ARTIFICIAL SEQUENCE
  Engineered albumin binding polypeptide
LAEAKSAANAELDKYGKSDFYKRLIDKAKTVEGVEALKDAILAACP

SEQ ID NO: 1235 - protein, 46 aa, ARTIFICIAL SEQUENCE
  Engineered albumin binding polypeptide
LAEAKSAANAELDKYGCSDFYKRLIDKAKTVEGVEALKDAILAACP

SEQ ID NO: 1236 - protein, 46 aa, ARTIFICIAL SEQUENCE
  Engineered albumin binding polypeptide
LAEAKSAANAELDKYGKSDFYKRLIDKAKTVEGVEALKDAILAAKP

SEQ ID NO: 1237 - protein, 46 aa, ARTIFICIAL SEQUENCE
  Engineered albumin binding polypeptide
LAEAKSAANSELDKYGCSDFYKRLIDKAKTVEGVEALKDAILAAKP

SEQ ID NO: 1238 - protein, 46 aa, ARTIFICIAL SEQUENCE
  Engineered albumin binding polypeptide
LAEAKSAANSELDKYGKSDFYKRLIDKAKTVEGVEALKDAILAACP

SEQ ID NO: 1239 - protein, 46 aa, ARTIFICIAL SEQUENCE
  Engineered albumin binding polypeptide
LAEAKSAANSELDKYGCSDFYKRLIDKAKTVEGVEALKDAILAACP

SEQ ID NO: 1240 - protein, 46 aa, ARTIFICIAL SEQUENCE
  Engineered albumin binding polypeptide
LAEAKSAANSELDKYGKSDFYKRLIDKAKTVEGVEALKDAILAAKP

SEQ ID NO: 1241 - protein, 46 aa, ARTIFICIAL SEQUENCE
  Engineered albumin binding polypeptide
LAQAKEAANAELDCYGCSDFYKRLIDKAKTVEGVEALKDAILAAKP

SEQ ID NO: 1242 - protein, 46 aa, ARTIFICIAL SEQUENCE
  Engineered albumin binding polypeptide
LAQAKEAANAELDCYGKSDFYKRLIDKAKTVEGVEALKDAILAACP

SEQ ID NO: 1243 - protein, 46 aa, ARTIFICIAL SEQUENCE
  Engineered albumin binding polypeptide
LAQAKEAANAELDCYGCSDFYKRLIDKAKTVEGVEALKDAILAACP

SEQ ID NO: 1244 - protein, 46 aa, ARTIFICIAL SEQUENCE
  Engineered albumin binding polypeptide
LAQAKEAANAELDCYGKSDFYKRLIDKAKTVEGVEALKDAILAAKP

SEQ ID NO: 1245 - protein, 46 aa, ARTIFICIAL SEQUENCE
  Engineered albumin binding polypeptide
LAQAKEAANSELDCYGCSDFYKRLIDKAKTVEGVEALKDAILAAKP

SEQ ID NO: 1246 - protein, 46 aa, ARTIFICIAL SEQUENCE
  Engineered albumin binding polypeptide
LAQAKEAANSELDCYGKSDFYKRLIDKAKTVEGVEALKDAILAACP

SEQ ID NO: 1247 - protein, 46 aa, ARTIFICIAL SEQUENCE
  Engineered albumin binding polypeptide
LAQAKEAANSELDCYGCSDFYKRLIDKAKTVEGVEALKDAILAACP

SEQ ID NO: 1248 - protein, 46 aa, ARTIFICIAL SEQUENCE
  Engineered albumin binding polypeptide
LAQAKEAANSELDCYGKSDFYKRLIDKAKTVEGVEALKDAILAAKP

SEQ ID NO: 1249 - protein, 46 aa, ARTIFICIAL SEQUENCE
  Engineered albumin binding polypeptide
LAQAKESANSELDCYGCSDFYKRLIDKAKTVEGVEALKDAILAAKP

SEQ ID NO: 1250 - protein, 46 aa, ARTIFICIAL SEQUENCE
  Engineered albumin binding polypeptide
LAQAKESANSELDCYGKSDFYKRLIDKAKTVEGVEALKDAILAACP

SEQ ID NO: 1251 - protein, 46 aa, ARTIFICIAL SEQUENCE
  Engineered albumin binding polypeptide
LAQAKESANSELDCYGCSDFYKRLIDKAKTVEGVEALKDAILAACP

SEQ ID NO: 1252 - protein, 46 aa, ARTIFICIAL SEQUENCE
  Engineered albumin binding polypeptide
LAQAKESANSELDCYGKSDFYKRLIDKAKTVEGVEALKDAILAAKP

SEQ ID NO: 1253 - protein, 46 aa, ARTIFICIAL SEQUENCE
  Engineered albumin binding polypeptide
LAQAKESANAELDCYGCSDFYKRLIDKAKTVEGVEALKDAILAAKP

SEQ ID NO: 1254 - protein, 46 aa, ARTIFICIAL SEQUENCE
  Engineered albumin binding polypeptide
LAQAKESANAELDCYGKSDFYKRLIDKAKTVEGVEALKDAILAACP

SEQ ID NO: 1255 - protein, 46 aa, ARTIFICIAL SEQUENCE
  Engineered albumin binding polypeptide
LAQAKESANAELDCYGCSDFYKRLIDKAKTVEGVEALKDAILAACP

SEQ ID NO: 1256 - protein, 46 aa, ARTIFICIAL SEQUENCE
  Engineered albumin binding polypeptide
LAQAKESANAELDCYGKSDFYKRLIDKAKTVEGVEALKDAILAAKP

SEQ ID NO: 1257 - protein, 46 aa, ARTIFICIAL SEQUENCE
  Engineered albumin binding polypeptide
LAQAKSAANAELDCYGCSDFYKRLIDKAKTVEGVEALKDAILAAKP

SEQ ID NO: 1258 - protein, 46 aa, ARTIFICIAL SEQUENCE
  Engineered albumin binding polypeptide
LAQAKSAANAELDCYGKSDFYKRLIDKAKTVEGVEALKDAILAACP

SEQ ID NO: 1259 - protein, 46 aa, ARTIFICIAL SEQUENCE
  Engineered albumin binding polypeptide
LAQAKSAANAELDCYGCSDFYKRLIDKAKTVEGVEALKDAILAACP

SEQ ID NO: 1260 - protein, 46 aa, ARTIFICIAL SEQUENCE
  Engineered albumin binding polypeptide
LAQAKSAANAELDCYGKSDFYKRLIDKAKTVEGVEALKDAILAAKP

SEQ ID NO: 1261 - protein, 46 aa, ARTIFICIAL SEQUENCE
  Engineered albumin binding polypeptide
LAQAKSAANSELDCYGCSDFYKRLIDKAKTVEGVEALKDAILAAKP

SEQ ID NO: 1262 - protein, 46 aa, ARTIFICIAL SEQUENCE
  Engineered albumin binding polypeptide
LAQAKSAANSELDCYGKSDFYKRLIDKAKTVEGVEALKDAILAACP

SEQ ID NO: 1263 - protein, 46 aa, ARTIFICIAL SEQUENCE
  Engineered albumin binding polypeptide
LAQAKSAANSELDCYGCSDFYKRLIDKAKTVEGVEALKDAILAACP

SEQ ID NO: 1264 - protein, 46 aa, ARTIFICIAL SEQUENCE
  Engineered albumin binding polypeptide
LAQAKSAANSELDCYGKSDFYKRLIDKAKTVEGVEALKDAILAAKP

SEQ ID NO: 1265 - protein, 46 aa, ARTIFICIAL SEQUENCE
  Engineered albumin binding polypeptide
LAQAKEAANAELDKYGCSDFYKRLIDKAKTVEGVEALKDAILAAKP

SEQ ID NO: 1266 - protein, 46 aa, ARTIFICIAL SEQUENCE
  Engineered albumin binding polypeptide
LAQAKEAANAELDKYGKSDFYKRLIDKAKTVEGVEALKDAILAACP

SEQ ID NO: 1267 - protein, 46 aa, ARTIFICIAL SEQUENCE
  Engineered albumin binding polypeptide
LAQAKEAANAELDKYGCSDFYKRLIDKAKTVEGVEALKDAILAACP

SEQ ID NO: 1268 - protein, 46 aa, ARTIFICIAL SEQUENCE
  Engineered albumin binding polypeptide
LAQAKEAANAELDKYGKSDFYKRLIDKAKTVEGVEALKDAILAAKP

SEQ ID NO: 1269 - protein, 46 aa, ARTIFICIAL SEQUENCE
  Engineered albumin binding polypeptide
LAQAKEAANSELDKYGCSDFYKRLIDKAKTVEGVEALKDAILAAKP

SEQ ID NO: 1270 - protein, 46 aa, ARTIFICIAL SEQUENCE
  Engineered albumin binding polypeptide
LAQAKEAANSELDKYGKSDFYKRLIDKAKTVEGVEALKDAILAACP

SEQ ID NO: 1271 - protein, 46 aa, ARTIFICIAL SEQUENCE
  Engineered albumin binding polypeptide
LAQAKEAANSELDKYGCSDFYKRLIDKAKTVEGVEALKDAILAACP

SEQ ID NO: 1272 - protein, 46 aa, ARTIFICIAL SEQUENCE
  Engineered albumin binding polypeptide
LAQAKEAANSELDKYGKSDFYKRLIDKAKTVEGVEALKDAILAAKP

SEQ ID NO: 1273 - protein, 46 aa, ARTIFICIAL SEQUENCE
  Engineered albumin binding polypeptide
LAQAKESANSELDKYGCSDFYKRLIDKAKTVEGVEALKDAILAAKP

SEQ ID NO: 1274 - protein, 46 aa, ARTIFICIAL SEQUENCE
  Engineered albumin binding polypeptide
LAQAKESANSELDKYGKSDFYKRLIDKAKTVEGVEALKDAILAACP

SEQ ID NO: 1275 - protein, 46 aa, ARTIFICIAL SEQUENCE
  Engineered albumin binding polypeptide
LAQAKESANSELDKYGCSDFYKRLIDKAKTVEGVEALKDAILAACP

SEQ ID NO: 1276 - protein, 46 aa, ARTIFICIAL SEQUENCE
  Engineered albumin binding polypeptide
LAQAKESANSELDKYGKSDFYKRLIDKAKTVEGVEALKDAILAAKP

SEQ ID NO: 1277 - protein, 46 aa, ARTIFICIAL SEQUENCE
  Engineered albumin binding polypeptide
LAQAKESANAELDKYGCSDFYKRLIDKAKTVEGVEALKDAILAAKP

SEQ ID NO: 1278 - protein, 46 aa, ARTIFICIAL SEQUENCE
  Engineered albumin binding polypeptide
LAQAKESANAELDKYGKSDFYKRLIDKAKTVEGVEALKDAILAACP

SEQ ID NO: 1279 - protein, 46 aa, ARTIFICIAL SEQUENCE
  Engineered albumin binding polypeptide
LAQAKESANAELDKYGCSDFYKRLIDKAKTVEGVEALKDAILAACP

SEQ ID NO: 1280 - protein, 46 aa, ARTIFICIAL SEQUENCE
  Engineered albumin binding polypeptide
LAQAKESANAELDKYGKSDFYKRLIDKAKTVEGVEALKDAILAAKP

SEQ ID NO: 1281 - protein, 46 aa, ARTIFICIAL SEQUENCE
  Engineered albumin binding polypeptide
LAQAKSAANAELDKYGCSDFYKRLIDKAKTVEGVEALKDAILAAKP

SEQ ID NO: 1282 - protein, 46 aa, ARTIFICIAL SEQUENCE
  Engineered albumin binding polypeptide
LAQAKSAANAELDKYGKSDFYKRLIDKAKTVEGVEALKDAILAACP

SEQ ID NO: 1283 - protein, 46 aa, ARTIFICIAL SEQUENCE
  Engineered albumin binding polypeptide
LAQAKSAANAELDKYGCSDFYKRLIDKAKTVEGVEALKDAILAACP

SEQ ID NO: 1284 - protein, 46 aa, ARTIFICIAL SEQUENCE
  Engineered albumin binding polypeptide
LAQAKSAANAELDKYGKSDFYKRLIDKAKTVEGVEALKDAILAAKP

SEQ ID NO: 1285 - protein, 46 aa, ARTIFICIAL SEQUENCE
  Engineered albumin binding polypeptide
LAQAKSAANSELDKYGCSDFYKRLIDKAKTVEGVEALKDAILAAKP

SEQ ID NO: 1286 - protein, 46 aa, ARTIFICIAL SEQUENCE
  Engineered albumin binding polypeptide
LAQAKSAANSELDKYGKSDFYKRLIDKAKTVEGVEALKDAILAACP

SEQ ID NO: 1287 - protein, 46 aa, ARTIFICIAL SEQUENCE
  Engineered albumin binding polypeptide
LAQAKSAANSELDKYGCSDFYKRLIDKAKTVEGVEALKDAILAACP

SEQ ID NO: 1288 - protein, 46 aa, ARTIFICIAL SEQUENCE
  Engineered albumin binding polypeptide
LAQAKSAANSELDKYGKSDFYKRLIDKAKTVEGVEALKDAILAAKP

SEQ ID NO: 1289 - protein, 46 aa, ARTIFICIAL SEQUENCE
  Engineered albumin binding polypeptide
LACAKEAANAELDCYGCSDFYKRLIDKAKTVEGVEALKDAILAAKP

SEQ ID NO: 1290 - protein, 46 aa, ARTIFICIAL SEQUENCE
  Engineered albumin binding polypeptide
LACAKEAANAELDCYGKSDFYKRLIDKAKTVEGVEALKDAILAACP

SEQ ID NO: 1291 - protein, 46 aa, ARTIFICIAL SEQUENCE
  Engineered albumin binding polypeptide
LACAKEAANAELDCYGCSDFYKRLIDKAKTVEGVEALKDAILAACP

SEQ ID NO: 1292 - protein, 46 aa, ARTIFICIAL SEQUENCE
  Engineered albumin binding polypeptide
LACAKEAANAELDCYGKSDFYKRLIDKAKTVEGVEALKDAILAAKP

SEQ ID NO: 1293 - protein, 46 aa, ARTIFICIAL SEQUENCE
  Engineered albumin binding polypeptide
LACAKEAANSELDCYGCSDFYKRLIDKAKTVEGVEALKDAILAAKP

SEQ ID NO: 1294 - protein, 46 aa, ARTIFICIAL SEQUENCE
  Engineered albumin binding polypeptide
LACAKEAANSELDCYGKSDFYKRLIDKAKTVEGVEALKDAILAACP

SEQ ID NO: 1295 - protein, 46 aa, ARTIFICIAL SEQUENCE
  Engineered albumin binding polypeptide
LACAKEAANSELDCYGCSDFYKRLIDKAKTVEGVEALKDAILAACP

SEQ ID NO: 1296 - protein, 46 aa, ARTIFICIAL SEQUENCE
  Engineered albumin binding polypeptide
LACAKEAANSELDCYGKSDFYKRLIDKAKTVEGVEALKDAILAAKP

SEQ ID NO: 1297 - protein, 46 aa, ARTIFICIAL SEQUENCE
  Engineered albumin binding polypeptide
LACAKESANSELDCYGCSDFYKRLIDKAKTVEGVEALKDAILAAKP

SEQ ID NO: 1298 - protein, 46 aa, ARTIFICIAL SEQUENCE
  Engineered albumin binding polypeptide
LACAKESANSELDCYGKSDFYKRLIDKAKTVEGVEALKDAILAACP

SEQ ID NO: 1299 - protein, 46 aa, ARTIFICIAL SEQUENCE
  Engineered albumin binding polypeptide
LACAKESANSELDCYGCSDFYKRLIDKAKTVEGVEALKDAILAACP

SEQ ID NO: 1300 - protein, 46 aa, ARTIFICIAL SEQUENCE
  Engineered albumin binding polypeptide
LACAKESANSELDCYGKSDFYKRLIDKAKTVEGVEALKDAILAAKP

SEQ ID NO: 1301 - protein, 46 aa, ARTIFICIAL SEQUENCE
  Engineered albumin binding polypeptide
LACAKESANAELDCYGCSDFYKRLIDKAKTVEGVEALKDAILAAKP

SEQ ID NO: 1302 - protein, 46 aa, ARTIFICIAL SEQUENCE
  Engineered albumin binding polypeptide
LACAKESANAELDCYGKSDFYKRLIDKAKTVEGVEALKDAILAACP

SEQ ID NO: 1303 - protein, 46 aa, ARTIFICIAL SEQUENCE
  Engineered albumin binding polypeptide
LACAKESANAELDCYGCSDFYKRLIDKAKTVEGVEALKDAILAACP

SEQ ID NO: 1304 - protein, 46 aa, ARTIFICIAL SEQUENCE
  Engineered albumin binding polypeptide
LACAKESANAELDCYGKSDFYKRLIDKAKTVEGVEALKDAILAAKP

SEQ ID NO: 1305 - protein, 46 aa, ARTIFICIAL SEQUENCE
  Engineered albumin binding polypeptide
LACAKSAANAELDCYGCSDFYKRLIDKAKTVEGVEALKDAILAAKP

SEQ ID NO: 1306 - protein, 46 aa, ARTIFICIAL SEQUENCE
  Engineered albumin binding polypeptide
LACAKSAANAELDCYGKSDFYKRLIDKAKTVEGVEALKDAILAACP

SEQ ID NO: 1307 - protein, 46 aa, ARTIFICIAL SEQUENCE
  Engineered albumin binding polypeptide
LACAKSAANAELDCYGCSDFYKRLIDKAKTVEGVEALKDAILAACP

SEQ ID NO: 1308 - protein, 46 aa, ARTIFICIAL SEQUENCE
  Engineered albumin binding polypeptide
LACAKSAANAELDCYGKSDFYKRLIDKAKTVEGVEALKDAILAAKP

SEQ ID NO: 1309 - protein, 46 aa, ARTIFICIAL SEQUENCE
  Engineered albumin binding polypeptide
LACAKSAANSELDCYGCSDFYKRLIDKAKTVEGVEALKDAILAAKP

SEQ ID NO: 1310 - protein, 46 aa, ARTIFICIAL SEQUENCE
  Engineered albumin binding polypeptide
LACAKSAANSELDCYGKSDFYKRLIDKAKTVEGVEALKDAILAACP

SEQ ID NO: 1311 - protein, 46 aa, ARTIFICIAL SEQUENCE
  Engineered albumin binding polypeptide
LACAKSAANSELDCYGCSDFYKRLIDKAKTVEGVEALKDAILAACP

SEQ ID NO: 1312 - protein, 46 aa, ARTIFICIAL SEQUENCE
  Engineered albumin binding polypeptide
LACAKSAANSELDCYGKSDFYKRLIDKAKTVEGVEALKDAILAAKP

SEQ ID NO: 1313 - protein, 46 aa, ARTIFICIAL SEQUENCE
  Engineered albumin binding polypeptide
LACAKEAANAELDKYGCSDFYKRLIDKAKTVEGVEALKDAILAAKP

SEQ ID NO: 1314 - protein, 46 aa, ARTIFICIAL SEQUENCE
  Engineered albumin binding polypeptide
LACAKEAANAELDKYGKSDFYKRLIDKAKTVEGVEALKDAILAACP

SEQ ID NO: 1315 - protein, 46 aa, ARTIFICIAL SEQUENCE
  Engineered albumin binding polypeptide
LACAKEAANAELDKYGCSDFYKRLIDKAKTVEGVEALKDAILAACP

SEQ ID NO: 1316 - protein, 46 aa, ARTIFICIAL SEQUENCE
  Engineered albumin binding polypeptide
LACAKEAANAELDKYGKSDFYKRLIDKAKTVEGVEALKDAILAAKP

SEQ ID NO: 1317 - protein, 46 aa, ARTIFICIAL SEQUENCE
  Engineered albumin binding polypeptide
LACAKEAANSELDKYGCSDFYKRLIDKAKTVEGVEALKDAILAAKP

SEQ ID NO: 1318 - protein, 46 aa, ARTIFICIAL SEQUENCE
  Engineered albumin binding polypeptide
LACAKEAANSELDKYGKSDFYKRLIDKAKTVEGVEALKDAILAACP

SEQ ID NO: 1319 - protein, 46 aa, ARTIFICIAL SEQUENCE
  Engineered albumin binding polypeptide
LACAKEAANSELDKYGCSDFYKRLIDKAKTVEGVEALKDAILAACP

SEQ ID NO: 1320 - protein, 46 aa, ARTIFICIAL SEQUENCE
  Engineered albumin binding polypeptide
LACAKEAANSELDKYGKSDFYKRLIDKAKTVEGVEALKDAILAAKP

SEQ ID NO: 1321 - protein, 46 aa, ARTIFICIAL SEQUENCE
  Engineered albumin binding polypeptide
LACAKESANSELDKYGCSDFYKRLIDKAKTVEGVEALKDAILAAKP

SEQ ID NO: 1322 - protein, 46 aa, ARTIFICIAL SEQUENCE
  Engineered albumin binding polypeptide
LACAKESANSELDKYGKSDFYKRLIDKAKTVEGVEALKDAILAACP

SEQ ID NO: 1323 - protein, 46 aa, ARTIFICIAL SEQUENCE
  Engineered albumin binding polypeptide
LACAKESANSELDKYGCSDFYKRLIDKAKTVEGVEALKDAILAACP

SEQ ID NO: 1324 - protein, 46 aa, ARTIFICIAL SEQUENCE
  Engineered albumin binding polypeptide
LACAKESANSELDKYGKSDFYKRLIDKAKTVEGVEALKDAILAAKP

SEQ ID NO: 1325 - protein, 46 aa, ARTIFICIAL SEQUENCE
  Engineered albumin binding polypeptide
LACAKESANAELDKYGCSDFYKRLIDKAKTVEGVEALKDAILAAKP

SEQ ID NO: 1326 - protein, 46 aa, ARTIFICIAL SEQUENCE
  Engineered albumin binding polypeptide
LACAKESANAELDKYGKSDFYKRLIDKAKTVEGVEALKDAILAACP

SEQ ID NO: 1327 - protein, 46 aa, ARTIFICIAL SEQUENCE
  Engineered albumin binding polypeptide
LACAKESANAELDKYGCSDFYKRLIDKAKTVEGVEALKDAILAACP

SEQ ID NO: 1328 - protein, 46 aa, ARTIFICIAL SEQUENCE
  Engineered albumin binding polypeptide
LACAKESANAELDKYGKSDFYKRLIDKAKTVEGVEALKDAILAAKP

SEQ ID NO: 1329 - protein, 46 aa, ARTIFICIAL SEQUENCE
  Engineered albumin binding polypeptide
LACAKSAANAELDKYGCSDFYKRLIDKAKTVEGVEALKDAILAAKP

SEQ ID NO: 1330 - protein, 46 aa, ARTIFICIAL SEQUENCE
  Engineered albumin binding polypeptide
LACAKSAANAELDKYGKSDFYKRLIDKAKTVEGVEALKDAILAACP

SEQ ID NO: 1331 - protein, 46 aa, ARTIFICIAL SEQUENCE
  Engineered albumin binding polypeptide
LACAKSAANAELDKYGCSDFYKRLIDKAKTVEGVEALKDAILAACP

SEQ ID NO: 1332 - protein, 46 aa, ARTIFICIAL SEQUENCE
  Engineered albumin binding polypeptide
LACAKSAANAELDKYGKSDFYKRLIDKAKTVEGVEALKDAILAAKP

SEQ ID NO: 1333 - protein, 46 aa, ARTIFICIAL SEQUENCE
  Engineered albumin binding polypeptide
LACAKSAANSELDKYGCSDFYKRLIDKAKTVEGVEALKDAILAAKP

SEQ ID NO: 1334 - protein, 46 aa, ARTIFICIAL SEQUENCE
  Engineered albumin binding polypeptide
LACAKSAANSELDKYGKSDFYKRLIDKAKTVEGVEALKDAILAACP

SEQ ID NO: 1335 - protein, 46 aa, ARTIFICIAL SEQUENCE
  Engineered albumin binding polypeptide
LACAKSAANSELDKYGCSDFYKRLIDKAKTVEGVEALKDAILAACP

SEQ ID NO: 1336 - protein, 46 aa, ARTIFICIAL SEQUENCE
  Engineered albumin binding polypeptide
LACAKSAANSELDKYGKSDFYKRLIDKAKTVEGVEALKDAILAAKP

SEQ ID NO: 1337 - protein, 46 aa, ARTIFICIAL SEQUENCE
  Engineered albumin binding polypeptide
LACAKEAANAELDSYGCSDFYKRLIDKAKTVEGVEALKDAILAAKP

SEQ ID NO: 1338 - protein, 46 aa, ARTIFICIAL SEQUENCE
  Engineered albumin binding polypeptide
LACAKEAANAELDSYGKSDFYKRLIDKAKTVEGVEALKDAILAACP

SEQ ID NO: 1339 - protein, 46 aa, ARTIFICIAL SEQUENCE
  Engineered albumin binding polypeptide
LACAKEAANAELDSYGCSDFYKRLIDKAKTVEGVEALKDAILAACP

SEQ ID NO: 1340 - protein, 46 aa, ARTIFICIAL SEQUENCE
  Engineered albumin binding polypeptide
LACAKEAANAELDSYGKSDFYKRLIDKAKTVEGVEALKDAILAAKP

SEQ ID NO: 1341 - protein, 46 aa, ARTIFICIAL SEQUENCE
  Engineered albumin binding polypeptide
LACAKEAANSELDSYGCSDFYKRLIDKAKTVEGVEALKDAILAAKP

SEQ ID NO: 1342 - protein, 46 aa, ARTIFICIAL SEQUENCE
  Engineered albumin binding polypeptide
LACAKEAANSELDSYGKSDFYKRLIDKAKTVEGVEALKDAILAACP

SEQ ID NO: 1343 - protein, 46 aa, ARTIFICIAL SEQUENCE
  Engineered albumin binding polypeptide
LACAKEAANSELDSYGCSDFYKRLIDKAKTVEGVEALKDAILAACP

SEQ ID NO: 1344 - protein, 46 aa, ARTIFICIAL SEQUENCE
  Engineered albumin binding polypeptide
LACAKEAANSELDSYGKSDFYKRLIDKAKTVEGVEALKDAILAAKP

SEQ ID NO: 1345 - protein, 46 aa, ARTIFICIAL SEQUENCE
  Engineered albumin binding polypeptide
LACAKESANSELDSYGCSDFYKRLIDKAKTVEGVEALKDAILAAKP

SEQ ID NO: 1346 - protein, 46 aa, ARTIFICIAL SEQUENCE
  Engineered albumin binding polypeptide
LACAKESANSELDSYGKSDFYKRLIDKAKTVEGVEALKDAILAACP

SEQ ID NO: 1347 - protein, 46 aa, ARTIFICIAL SEQUENCE
  Engineered albumin binding polypeptide
LACAKESANSELDSYGCSDFYKRLIDKAKTVEGVEALKDAILAACP

SEQ ID NO: 1348 - protein, 46 aa, ARTIFICIAL SEQUENCE
  Engineered albumin binding polypeptide
LACAKESANSELDSYGKSDFYKRLIDKAKTVEGVEALKDAILAAKP

SEQ ID NO: 1349 - protein, 46 aa, ARTIFICIAL SEQUENCE
  Engineered albumin binding polypeptide
LACAKESANAELDSYGCSDFYKRLIDKAKTVEGVEALKDAILAAKP

SEQ ID NO: 1350 - protein, 46 aa, ARTIFICIAL SEQUENCE
  Engineered albumin binding polypeptide
LACAKESANAELDSYGKSDFYKRLIDKAKTVEGVEALKDAILAACP

SEQ ID NO: 1351 - protein, 46 aa, ARTIFICIAL SEQUENCE
  Engineered albumin binding polypeptide
LACAKESANAELDSYGCSDFYKRLIDKAKTVEGVEALKDAILAACP

SEQ ID NO: 1352 - protein, 46 aa, ARTIFICIAL SEQUENCE
  Engineered albumin binding polypeptide
LACAKESANAELDSYGKSDFYKRLIDKAKTVEGVEALKDAILAAKP

SEQ ID NO: 1353 - protein, 46 aa, ARTIFICIAL SEQUENCE
  Engineered albumin binding polypeptide
LACAKSAANAELDSYGCSDFYKRLIDKAKTVEGVEALKDAILAAKP

SEQ ID NO: 1354 - protein, 46 aa, ARTIFICIAL SEQUENCE
  Engineered albumin binding polypeptide
LACAKSAANAELDSYGKSDFYKRLIDKAKTVEGVEALKDAILAACP

SEQ ID NO: 1355 - protein, 46 aa, ARTIFICIAL SEQUENCE
  Engineered albumin binding polypeptide
LACAKSAANAELDSYGCSDFYKRLIDKAKTVEGVEALKDAILAACP

SEQ ID NO: 1356 - protein, 46 aa, ARTIFICIAL SEQUENCE
  Engineered albumin binding polypeptide
LACAKSAANAELDSYGKSDFYKRLIDKAKTVEGVEALKDAILAAKP

SEQ ID NO: 1357 - protein, 46 aa, ARTIFICIAL SEQUENCE
  Engineered albumin binding polypeptide
LACAKSAANSELDSYGCSDFYKRLIDKAKTVEGVEALKDAILAAKP

SEQ ID NO: 1358 - protein, 46 aa, ARTIFICIAL SEQUENCE
  Engineered albumin binding polypeptide
LACAKSAANSELDSYGKSDFYKRLIDKAKTVEGVEALKDAILAACP

SEQ ID NO: 1359 - protein, 46 aa, ARTIFICIAL SEQUENCE
  Engineered albumin binding polypeptide
LACAKSAANSELDSYGCSDFYKRLIDKAKTVEGVEALKDAILAACP

SEQ ID NO: 1360 - protein, 46 aa, ARTIFICIAL SEQUENCE
  Engineered albumin binding polypeptide
LACAKSAANSELDSYGKSDFYKRLIDKAKTVEGVEALKDAILAAKP

SEQ ID NO: 1361 - protein, 46 aa, ARTIFICIAL SEQUENCE
  Engineered albumin binding polypeptide
LACAKEAANAELDAYGCSDFYKRLIDKAKTVEGVEALKDAILAAKP

SEQ ID NO: 1362 - protein, 46 aa, ARTIFICIAL SEQUENCE
  Engineered albumin binding polypeptide
LACAKEAANAELDAYGKSDFYKRLIDKAKTVEGVEALKDAILAACP

SEQ ID NO: 1363 - protein, 46 aa, ARTIFICIAL SEQUENCE
  Engineered albumin binding polypeptide
LACAKEAANAELDAYGCSDFYKRLIDKAKTVEGVEALKDAILAACP

SEQ ID NO: 1364 - protein, 46 aa, ARTIFICIAL SEQUENCE
  Engineered albumin binding polypeptide
LACAKEAANAELDAYGKSDFYKRLIDKAKTVEGVEALKDAILAAKP

SEQ ID NO: 1365 - protein, 46 aa, ARTIFICIAL SEQUENCE
  Engineered albumin binding polypeptide
LACAKEAANSELDAYGCSDFYKRLIDKAKTVEGVEALKDAILAAKP

SEQ ID NO: 1366 - protein, 46 aa, ARTIFICIAL SEQUENCE
  Engineered albumin binding polypeptide
LACAKEAANSELDAYGKSDFYKRLIDKAKTVEGVEALKDAILAACP

SEQ ID NO: 1367 - protein, 46 aa, ARTIFICIAL SEQUENCE
  Engineered albumin binding polypeptide
LACAKEAANSELDAYGCSDFYKRLIDKAKTVEGVEALKDAILAACP

SEQ ID NO: 1368 - protein, 46 aa, ARTIFICIAL SEQUENCE
  Engineered albumin binding polypeptide
LACAKEAANSELDAYGKSDFYKRLIDKAKTVEGVEALKDAILAAKP

SEQ ID NO: 1369 - protein, 46 aa, ARTIFICIAL SEQUENCE
  Engineered albumin binding polypeptide
LACAKESANSELDAYGCSDFYKRLIDKAKTVEGVEALKDAILAAKP

SEQ ID NO: 1370 - protein, 46 aa, ARTIFICIAL SEQUENCE
  Engineered albumin binding polypeptide
LACAKESANSELDAYGKSDFYKRLIDKAKTVEGVEALKDAILAACP

SEQ ID NO: 1371 - protein, 46 aa, ARTIFICIAL SEQUENCE
  Engineered albumin binding polypeptide
LACAKESANSELDAYGCSDFYKRLIDKAKTVEGVEALKDAILAACP

SEQ ID NO: 1372 - protein, 46 aa, ARTIFICIAL SEQUENCE
  Engineered albumin binding polypeptide
LACAKESANSELDAYGKSDFYKRLIDKAKTVEGVEALKDAILAAKP

SEQ ID NO: 1373 - protein, 46 aa, ARTIFICIAL SEQUENCE
  Engineered albumin binding polypeptide
LACAKESANAELDAYGCSDFYKRLIDKAKTVEGVEALKDAILAAKP

SEQ ID NO: 1374 - protein, 46 aa, ARTIFICIAL SEQUENCE
  Engineered albumin binding polypeptide
LACAKESANAELDAYGKSDFYKRLIDKAKTVEGVEALKDAILAACP

SEQ ID NO: 1375 - protein, 46 aa, ARTIFICIAL SEQUENCE
  Engineered albumin binding polypeptide
LACAKESANAELDAYGCSDFYKRLIDKAKTVEGVEALKDAILAACP

SEQ ID NO: 1376 - protein, 46 aa, ARTIFICIAL SEQUENCE
  Engineered albumin binding polypeptide
LACAKESANAELDAYGKSDFYKRLIDKAKTVEGVEALKDAILAAKP

SEQ ID NO: 1377 - protein, 46 aa, ARTIFICIAL SEQUENCE
  Engineered albumin binding polypeptide
LACAKSAANAELDAYGCSDFYKRLIDKAKTVEGVEALKDAILAAKP

SEQ ID NO: 1378 - protein, 46 aa, ARTIFICIAL SEQUENCE
  Engineered albumin binding polypeptide
LACAKSAANAELDAYGKSDFYKRLIDKAKTVEGVEALKDAILAACP

SEQ ID NO: 1379 - protein, 46 aa, ARTIFICIAL SEQUENCE
  Engineered albumin binding polypeptide
LACAKSAANAELDAYGCSDFYKRLIDKAKTVEGVEALKDAILAACP

SEQ ID NO: 1380 - protein, 46 aa, ARTIFICIAL SEQUENCE
  Engineered albumin binding polypeptide
LACAKSAANAELDAYGKSDFYKRLIDKAKTVEGVEALKDAILAAKP

SEQ ID NO: 1381 - protein, 46 aa, ARTIFICIAL SEQUENCE
  Engineered albumin binding polypeptide
LACAKSAANSELDAYGCSDFYKRLIDKAKTVEGVEALKDAILAAKP

SEQ ID NO: 1382 - protein, 46 aa, ARTIFICIAL SEQUENCE
  Engineered albumin binding polypeptide
LACAKSAANSELDAYGKSDFYKRLIDKAKTVEGVEALKDAILAACP

SEQ ID NO: 1383 - protein, 46 aa, ARTIFICIAL SEQUENCE
  Engineered albumin binding polypeptide
LACAKSAANSELDAYGCSDFYKRLIDKAKTVEGVEALKDAILAACP

SEQ ID NO: 1384 - protein, 46 aa, ARTIFICIAL SEQUENCE
  Engineered albumin binding polypeptide
LACAKSAANSELDAYGKSDFYKRLIDKAKTVEGVEALKDAILAAKP

SEQ ID NO: 1385 - protein, 46 aa, ARTIFICIAL SEQUENCE
  Engineered albumin binding polypeptide
LAQAKCAANAELDAYGCSDFYKRLIDKAKTVEGVEALKDAILAAKP

SEQ ID NO: 1386 - protein, 46 aa, ARTIFICIAL SEQUENCE
  Engineered albumin binding polypeptide
LAQAKCAANAELDAYGKSDFYKRLIDKAKTVEGVEALKDAILAACP

SEQ ID NO: 1387 - protein, 46 aa, ARTIFICIAL SEQUENCE
  Engineered albumin binding polypeptide
LAQAKCAANAELDAYGCSDFYKRLIDKAKTVEGVEALKDAILAACP

SEQ ID NO: 1388 - protein, 46 aa, ARTIFICIAL SEQUENCE
  Engineered albumin binding polypeptide
LAQAKCAANAELDAYGKSDFYKRLIDKAKTVEGVEALKDAILAAKP

SEQ ID NO: 1389 - protein, 46 aa, ARTIFICIAL SEQUENCE
  Engineered albumin binding polypeptide
LAQAKCAANSELDAYGCSDFYKRLIDKAKTVEGVEALKDAILAAKP

SEQ ID NO: 1390 - protein, 46 aa, ARTIFICIAL SEQUENCE
  Engineered albumin binding polypeptide
LAQAKCAANSELDAYGKSDFYKRLIDKAKTVEGVEALKDAILAACP

SEQ ID NO: 1391 - protein, 46 aa, ARTIFICIAL SEQUENCE
  Engineered albumin binding polypeptide
LAQAKCAANSELDAYGCSDFYKRLIDKAKTVEGVEALKDAILAACP

SEQ ID NO: 1392 - protein, 46 aa, ARTIFICIAL SEQUENCE
  Engineered albumin binding polypeptide
LAQAKCAANSELDAYGKSDFYKRLIDKAKTVEGVEALKDAILAAKP

SEQ ID NO: 1393 - protein, 46 aa, ARTIFICIAL SEQUENCE
  Engineered albumin binding polypeptide
LAQAKCSANSELDAYGCSDFYKRLIDKAKTVEGVEALKDAILAAKP

SEQ ID NO: 1394 - protein, 46 aa, ARTIFICIAL SEQUENCE
  Engineered albumin binding polypeptide
LAQAKCSANSELDAYGKSDFYKRLIDKAKTVEGVEALKDAILAACP

SEQ ID NO: 1395 - protein, 46 aa, ARTIFICIAL SEQUENCE
  Engineered albumin binding polypeptide
LAQAKCSANSELDAYGCSDFYKRLIDKAKTVEGVEALKDAILAACP

SEQ ID NO: 1396 - protein, 46 aa, ARTIFICIAL SEQUENCE
  Engineered albumin binding polypeptide
LAQAKCSANSELDAYGKSDFYKRLIDKAKTVEGVEALKDAILAAKP

SEQ ID NO: 1397 - protein, 46 aa, ARTIFICIAL SEQUENCE
  Engineered albumin binding polypeptide
LAQAKCSANAELDAYGCSDFYKRLIDKAKTVEGVEALKDAILAAKP

SEQ ID NO: 1398 - protein, 46 aa, ARTIFICIAL SEQUENCE
  Engineered albumin binding polypeptide
LAQAKCSANAELDAYGKSDFYKRLIDKAKTVEGVEALKDAILAACP

SEQ ID NO: 1399 - protein, 46 aa, ARTIFICIAL SEQUENCE
  Engineered albumin binding polypeptide
LAQAKCSANAELDAYGCSDFYKRLIDKAKTVEGVEALKDAILAACP

SEQ ID NO: 1400 - protein, 46 aa, ARTIFICIAL SEQUENCE
  Engineered albumin binding polypeptide
LAQAKCSANAELDAYGKSDFYKRLIDKAKTVEGVEALKDAILAAKP

SEQ ID NO: 1401 - protein, 46 aa, ARTIFICIAL SEQUENCE
  Engineered albumin binding polypeptide
LAQAKCAANAELDCYGCSDFYKRLIDKAKTVEGVEALKDAILAAKP

SEQ ID NO: 1402 - protein, 46 aa, ARTIFICIAL SEQUENCE
  Engineered albumin binding polypeptide
LAQAKCAANAELDCYGKSDFYKRLIDKAKTVEGVEALKDAILAACP

SEQ ID NO: 1403 - protein, 46 aa, ARTIFICIAL SEQUENCE
  Engineered albumin binding polypeptide
LAQAKCAANAELDCYGCSDFYKRLIDKAKTVEGVEALKDAILAACP

SEQ ID NO: 1404 - protein, 46 aa, ARTIFICIAL SEQUENCE
  Engineered albumin binding polypeptide
LAQAKCAANAELDCYGKSDFYKRLIDKAKTVEGVEALKDAILAAKP

SEQ ID NO: 1405 - protein, 46 aa, ARTIFICIAL SEQUENCE
  Engineered albumin binding polypeptide
LAQAKCAANSELDCYGCSDFYKRLIDKAKTVEGVEALKDAILAAKP

SEQ ID NO: 1406 - protein, 46 aa, ARTIFICIAL SEQUENCE
  Engineered albumin binding polypeptide
LAQAKCAANSELDCYGKSDFYKRLIDKAKTVEGVEALKDAILAACP

SEQ ID NO: 1407 - protein, 46 aa, ARTIFICIAL SEQUENCE
  Engineered albumin binding polypeptide
LAQAKCAANSELDCYGCSDFYKRLIDKAKTVEGVEALKDAILAACP

SEQ ID NO: 1408 - protein, 46 aa, ARTIFICIAL SEQUENCE
  Engineered albumin binding polypeptide
LAQAKCAANSELDCYGKSDFYKRLIDKAKTVEGVEALKDAILAAKP

SEQ ID NO: 1409 - protein, 46 aa, ARTIFICIAL SEQUENCE
  Engineered albumin binding polypeptide
LAQAKCAANAELDSYGCSDFYKRLIDKAKTVEGVEALKDAILAAKP

SEQ ID NO: 1410 - protein, 46 aa, ARTIFICIAL SEQUENCE
  Engineered albumin binding polypeptide
LAQAKCAANAELDSYGKSDFYKRLIDKAKTVEGVEALKDAILAACP

SEQ ID NO: 1411 - protein, 46 aa, ARTIFICIAL SEQUENCE
  Engineered albumin binding polypeptide
LAQAKCAANAELDSYGCSDFYKRLIDKAKTVEGVEALKDAILAACP

SEQ ID NO: 1412 - protein, 46 aa, ARTIFICIAL SEQUENCE
  Engineered albumin binding polypeptide
LAQAKCAANAELDSYGKSDFYKRLIDKAKTVEGVEALKDAILAAKP

SEQ ID NO: 1413 - protein, 46 aa, ARTIFICIAL SEQUENCE
  Engineered albumin binding polypeptide
LAQAKCAANSELDSYGCSDFYKRLIDKAKTVEGVEALKDAILAAKP

SEQ ID NO: 1414 - protein, 46 aa, ARTIFICIAL SEQUENCE
  Engineered albumin binding polypeptide
LAQAKCAANSELDSYGKSDFYKRLIDKAKTVEGVEALKDAILAACP

SEQ ID NO: 1415 - protein, 46 aa, ARTIFICIAL SEQUENCE
  Engineered albumin binding polypeptide
LAQAKCAANSELDSYGCSDFYKRLIDKAKTVEGVEALKDAILAACP

SEQ ID NO: 1416 - protein, 46 aa, ARTIFICIAL SEQUENCE
  Engineered albumin binding polypeptide
LAQAKCAANSELDSYGKSDFYKRLIDKAKTVEGVEALKDAILAAKP

SEQ ID NO: 1417 - protein, 46 aa, ARTIFICIAL SEQUENCE
  Engineered albumin binding polypeptide
LAQAKCSANSELDSYGCSDFYKRLIDKAKTVEGVEALKDAILAAKP

SEQ ID NO: 1418 - protein, 46 aa, ARTIFICIAL SEQUENCE
  Engineered albumin binding polypeptide
LAQAKCSANSELDSYGKSDFYKRLIDKAKTVEGVEALKDAILAACP

SEQ ID NO: 1419 - protein, 46 aa, ARTIFICIAL SEQUENCE
  Engineered albumin binding polypeptide
LAQAKCSANSELDSYGCSDFYKRLIDKAKTVEGVEALKDAILAACP

SEQ ID NO: 1420 - protein, 46 aa, ARTIFICIAL SEQUENCE
  Engineered albumin binding polypeptide
LAQAKCSANSELDSYGKSDFYKRLIDKAKTVEGVEALKDAILAAKP

SEQ ID NO: 1421 - protein, 46 aa, ARTIFICIAL SEQUENCE
  Engineered albumin binding polypeptide
LAQAKCSANAELDSYGCSDFYKRLIDKAKTVEGVEALKDAILAAKP

SEQ ID NO: 1422 - protein, 46 aa, ARTIFICIAL SEQUENCE
  Engineered albumin binding polypeptide
LAQAKCSANAELDSYGKSDFYKRLIDKAKTVEGVEALKDAILAACP

SEQ ID NO: 1423 - protein, 46 aa, ARTIFICIAL SEQUENCE
  Engineered albumin binding polypeptide
LAQAKCSANAELDSYGCSDFYKRLIDKAKTVEGVEALKDAILAACP

SEQ ID NO: 1424 - protein, 46 aa, ARTIFICIAL SEQUENCE
  Engineered albumin binding polypeptide
LAQAKCSANAELDSYGKSDFYKRLIDKAKTVEGVEALKDAILAAKP

SEQ ID NO: 1425 - protein, 46 aa, ARTIFICIAL SEQUENCE
  Engineered albumin binding polypeptide
LAQAKCAANAELDKYGCSDFYKRLIDKAKTVEGVEALKDAILAAKP

SEQ ID NO: 1426 - protein, 46 aa, ARTIFICIAL SEQUENCE
  Engineered albumin binding polypeptide
LAQAKCAANAELDKYGKSDFYKRLIDKAKTVEGVEALKDAILAACP

SEQ ID NO: 1427 - protein, 46 aa, ARTIFICIAL SEQUENCE
  Engineered albumin binding polypeptide
LAQAKCAANAELDKYGCSDFYKRLIDKAKTVEGVEALKDAILAACP

SEQ ID NO: 1428 - protein, 46 aa, ARTIFICIAL SEQUENCE
  Engineered albumin binding polypeptide
LAQAKCAANAELDKYGKSDFYKRLIDKAKTVEGVEALKDAILAAKP

SEQ ID NO: 1429 - protein, 46 aa, ARTIFICIAL SEQUENCE
  Engineered albumin binding polypeptide
LAQAKCAANSELDKYGCSDFYKRLIDKAKTVEGVEALKDAILAAKP

SEQ ID NO: 1430 - protein, 46 aa, ARTIFICIAL SEQUENCE
  Engineered albumin binding polypeptide
LAQAKCAANSELDKYGKSDFYKRLIDKAKTVEGVEALKDAILAACP

SEQ ID NO: 1431 - protein, 46 aa, ARTIFICIAL SEQUENCE
  Engineered albumin binding polypeptide
LAQAKCAANSELDKYGCSDFYKRLIDKAKTVEGVEALKDAILAACP

SEQ ID NO: 1432 - protein, 46 aa, ARTIFICIAL SEQUENCE
  Engineered albumin binding polypeptide
LAQAKCAANSELDKYGKSDFYKRLIDKAKTVEGVEALKDAILAAKP

SEQ ID NO: 1433 - protein, 46 aa, ARTIFICIAL SEQUENCE
  Engineered albumin binding polypeptide
LASAKCAANAELDAYGCSDFYKRLIDKAKTVEGVEALKDAILAAKP

SEQ ID NO: 1434 - protein, 46 aa, ARTIFICIAL SEQUENCE
  Engineered albumin binding polypeptide
LASAKCAANAELDAYGKSDFYKRLIDKAKTVEGVEALKDAILAACP

SEQ ID NO: 1435 - protein, 46 aa, ARTIFICIAL SEQUENCE
  Engineered albumin binding polypeptide
LASAKCAANAELDAYGCSDFYKRLIDKAKTVEGVEALKDAILAACP

SEQ ID NO: 1436 - protein, 46 aa, ARTIFICIAL SEQUENCE
  Engineered albumin binding polypeptide
LASAKCAANAELDAYGKSDFYKRLIDKAKTVEGVEALKDAILAAKP

SEQ ID NO: 1437 - protein, 46 aa, ARTIFICIAL SEQUENCE
  Engineered albumin binding polypeptide
LASAKCAANSELDAYGCSDFYKRLIDKAKTVEGVEALKDAILAAKP

SEQ ID NO: 1438 - protein, 46 aa, ARTIFICIAL SEQUENCE
  Engineered albumin binding polypeptide
LASAKCAANSELDAYGKSDFYKRLIDKAKTVEGVEALKDAILAACP

SEQ ID NO: 1439 - protein, 46 aa, ARTIFICIAL SEQUENCE
  Engineered albumin binding polypeptide
LASAKCAANSELDAYGCSDFYKRLIDKAKTVEGVEALKDAILAACP

SEQ ID NO: 1440 - protein, 46 aa, ARTIFICIAL SEQUENCE
  Engineered albumin binding polypeptide
LASAKCAANSELDAYGKSDFYKRLIDKAKTVEGVEALKDAILAAKP

SEQ ID NO: 1441 - protein, 46 aa, ARTIFICIAL SEQUENCE
  Engineered albumin binding polypeptide
LASAKCSANSELDAYGCSDFYKRLIDKAKTVEGVEALKDAILAAKP

SEQ ID NO: 1442 - protein, 46 aa, ARTIFICIAL SEQUENCE
  Engineered albumin binding polypeptide
LASAKCSANSELDAYGKSDFYKRLIDKAKTVEGVEALKDAILAACP

SEQ ID NO: 1443 - protein, 46 aa, ARTIFICIAL SEQUENCE
  Engineered albumin binding polypeptide
LASAKCSANSELDAYGCSDFYKRLIDKAKTVEGVEALKDAILAACP

SEQ ID NO: 1444 - protein, 46 aa, ARTIFICIAL SEQUENCE
  Engineered albumin binding polypeptide
LASAKCSANSELDAYGKSDFYKRLIDKAKTVEGVEALKDAILAAKP

SEQ ID NO: 1445 - protein, 46 aa, ARTIFICIAL SEQUENCE
  Engineered albumin binding polypeptide
LASAKCSANAELDAYGCSDFYKRLIDKAKTVEGVEALKDAILAAKP

SEQ ID NO: 1446 - protein, 46 aa, ARTIFICIAL SEQUENCE
  Engineered albumin binding polypeptide
LASAKCSANAELDAYGKSDFYKRLIDKAKTVEGVEALKDAILAACP

SEQ ID NO: 1447 - protein, 46 aa, ARTIFICIAL SEQUENCE
  Engineered albumin binding polypeptide
LASAKCSANAELDAYGCSDFYKRLIDKAKTVEGVEALKDAILAACP

SEQ ID NO: 1448 - protein, 46 aa, ARTIFICIAL SEQUENCE
  Engineered albumin binding polypeptide
LASAKCSANAELDAYGKSDFYKRLIDKAKTVEGVEALKDAILAAKP

SEQ ID NO: 1449 - protein, 46 aa, ARTIFICIAL SEQUENCE
  Engineered albumin binding polypeptide
LASAKCAANAELDCYGCSDFYKRLIDKAKTVEGVEALKDAILAAKP

SEQ ID NO: 1450 - protein, 46 aa, ARTIFICIAL SEQUENCE
  Engineered albumin binding polypeptide
LASAKCAANAELDCYGKSDFYKRLIDKAKTVEGVEALKDAILAACP

SEQ ID NO: 1451 - protein, 46 aa, ARTIFICIAL SEQUENCE
  Engineered albumin binding polypeptide
LASAKCAANAELDCYGCSDFYKRLIDKAKTVEGVEALKDAILAACP

SEQ ID NO: 1452 - protein, 46 aa, ARTIFICIAL SEQUENCE
  Engineered albumin binding polypeptide
LASAKCAANAELDCYGKSDFYKRLIDKAKTVEGVEALKDAILAAKP

SEQ ID NO: 1453 - protein, 46 aa, ARTIFICIAL SEQUENCE
  Engineered albumin binding polypeptide
LASAKCAANSELDCYGCSDFYKRLIDKAKTVEGVEALKDAILAAKP

SEQ ID NO: 1454 - protein, 46 aa, ARTIFICIAL SEQUENCE
  Engineered albumin binding polypeptide
LASAKCAANSELDCYGKSDFYKRLIDKAKTVEGVEALKDAILAACP

SEQ ID NO: 1455 - protein, 46 aa, ARTIFICIAL SEQUENCE
  Engineered albumin binding polypeptide
LASAKCAANSELDCYGCSDFYKRLIDKAKTVEGVEALKDAILAACP

SEQ ID NO: 1456 - protein, 46 aa, ARTIFICIAL SEQUENCE
  Engineered albumin binding polypeptide
LASAKCAANSELDCYGKSDFYKRLIDKAKTVEGVEALKDAILAAKP

SEQ ID NO: 1457 - protein, 46 aa, ARTIFICIAL SEQUENCE
  Engineered albumin binding polypeptide
LASAKCAANAELDSYGCSDFYKRLIDKAKTVEGVEALKDAILAAKP

SEQ ID NO: 1458 - protein, 46 aa, ARTIFICIAL SEQUENCE
  Engineered albumin binding polypeptide
LASAKCAANAELDSYGKSDFYKRLIDKAKTVEGVEALKDAILAACP

SEQ ID NO: 1459 - protein, 46 aa, ARTIFICIAL SEQUENCE
  Engineered albumin binding polypeptide
LASAKCAANAELDSYGCSDFYKRLIDKAKTVEGVEALKDAILAACP

SEQ ID NO: 1460 - protein, 46 aa, ARTIFICIAL SEQUENCE
  Engineered albumin binding polypeptide
LASAKCAANAELDSYGKSDFYKRLIDKAKTVEGVEALKDAILAAKP

SEQ ID NO: 1461 - protein, 46 aa, ARTIFICIAL SEQUENCE
  Engineered albumin binding polypeptide
LASAKCAANSELDSYGCSDFYKRLIDKAKTVEGVEALKDAILAAKP

SEQ ID NO: 1462 - protein, 46 aa, ARTIFICIAL SEQUENCE
  Engineered albumin binding polypeptide
LASAKCAANSELDSYGKSDFYKRLIDKAKTVEGVEALKDAILAACP

SEQ ID NO: 1463 - protein, 46 aa, ARTIFICIAL SEQUENCE
  Engineered albumin binding polypeptide
LASAKCAANSELDSYGCSDFYKRLIDKAKTVEGVEALKDAILAACP

SEQ ID NO: 1464 - protein, 46 aa, ARTIFICIAL SEQUENCE
  Engineered albumin binding polypeptide
LASAKCAANSELDSYGKSDFYKRLIDKAKTVEGVEALKDAILAAKP

SEQ ID NO: 1465 - protein, 46 aa, ARTIFICIAL SEQUENCE
  Engineered albumin binding polypeptide
LASAKCSANSELDSYGCSDFYKRLIDKAKTVEGVEALKDAILAAKP

SEQ ID NO: 1466 - protein, 46 aa, ARTIFICIAL SEQUENCE
  Engineered albumin binding polypeptide
LASAKCSANSELDSYGKSDFYKRLIDKAKTVEGVEALKDAILAACP

SEQ ID NO: 1467 - protein, 46 aa, ARTIFICIAL SEQUENCE
  Engineered albumin binding polypeptide
LASAKCSANSELDSYGCSDFYKRLIDKAKTVEGVEALKDAILAACP

SEQ ID NO: 1468 - protein, 46 aa, ARTIFICIAL SEQUENCE
  Engineered albumin binding polypeptide
LASAKCSANSELDSYGKSDFYKRLIDKAKTVEGVEALKDAILAAKP

SEQ ID NO: 1469 - protein, 46 aa, ARTIFICIAL SEQUENCE
  Engineered albumin binding polypeptide
LASAKCSANAELDSYGCSDFYKRLIDKAKTVEGVEALKDAILAAKP

SEQ ID NO: 1470 - protein, 46 aa, ARTIFICIAL SEQUENCE
  Engineered albumin binding polypeptide
LASAKCSANAELDSYGKSDFYKRLIDKAKTVEGVEALKDAILAACP

SEQ ID NO: 1471 - protein, 46 aa, ARTIFICIAL SEQUENCE
  Engineered albumin binding polypeptide
LASAKCSANAELDSYGCSDFYKRLIDKAKTVEGVEALKDAILAACP

SEQ ID NO: 1472 - protein, 46 aa, ARTIFICIAL SEQUENCE
  Engineered albumin binding polypeptide
LASAKCSANAELDSYGKSDFYKRLIDKAKTVEGVEALKDAILAAKP

SEQ ID NO: 1473 - protein, 46 aa, ARTIFICIAL SEQUENCE
  Engineered albumin binding polypeptide
LASAKCAANAELDKYGCSDFYKRLIDKAKTVEGVEALKDAILAAKP

SEQ ID NO: 1474 - protein, 46 aa, ARTIFICIAL SEQUENCE
  Engineered albumin binding polypeptide
LASAKCAANAELDKYGKSDFYKRLIDKAKTVEGVEALKDAILAACP

SEQ ID NO: 1475 - protein, 46 aa, ARTIFICIAL SEQUENCE
  Engineered albumin binding polypeptide
LASAKCAANAELDKYGCSDFYKRLIDKAKTVEGVEALKDAILAACP

SEQ ID NO: 1476 - protein, 46 aa, ARTIFICIAL SEQUENCE
  Engineered albumin binding polypeptide
LASAKCAANAELDKYGKSDFYKRLIDKAKTVEGVEALKDAILAAKP

SEQ ID NO: 1477 - protein, 46 aa, ARTIFICIAL SEQUENCE
  Engineered albumin binding polypeptide
LASAKCAANSELDKYGCSDFYKRLIDKAKTVEGVEALKDAILAAKP

SEQ ID NO: 1478 - protein, 46 aa, ARTIFICIAL SEQUENCE
  Engineered albumin binding polypeptide
LASAKCAANSELDKYGKSDFYKRLIDKAKTVEGVEALKDAILAACP

SEQ ID NO: 1479 - protein, 46 aa, ARTIFICIAL SEQUENCE
  Engineered albumin binding polypeptide
LASAKCAANSELDKYGCSDFYKRLIDKAKTVEGVEALKDAILAACP

SEQ ID NO: 1480 - protein, 46 aa, ARTIFICIAL SEQUENCE
  Engineered albumin binding polypeptide
LASAKCAANSELDKYGKSDFYKRLIDKAKTVEGVEALKDAILAAKP

SEQ ID NO: 1481 - protein, 46 aa, ARTIFICIAL SEQUENCE
  Engineered albumin binding polypeptide
LAEAKCAANAELDAYGCSDFYKRLIDKAKTVEGVEALKDAILAAKP

SEQ ID NO: 1482 - protein, 46 aa, ARTIFICIAL SEQUENCE
  Engineered albumin binding polypeptide
LAEAKCAANAELDAYGKSDFYKRLIDKAKTVEGVEALKDAILAACP

SEQ ID NO: 1483 - protein, 46 aa, ARTIFICIAL SEQUENCE
  Engineered albumin binding polypeptide
LAEAKCAANAELDAYGCSDFYKRLIDKAKTVEGVEALKDAILAACP

SEQ ID NO: 1484 - protein, 46 aa, ARTIFICIAL SEQUENCE
  Engineered albumin binding polypeptide
LAEAKCAANAELDAYGKSDFYKRLIDKAKTVEGVEALKDAILAAKP

SEQ ID NO: 1485 - protein, 46 aa, ARTIFICIAL SEQUENCE
  Engineered albumin binding polypeptide
LAEAKCAANSELDAYGCSDFYKRLIDKAKTVEGVEALKDAILAAKP

SEQ ID NO: 1486 - protein, 46 aa, ARTIFICIAL SEQUENCE
  Engineered albumin binding polypeptide
LAEAKCAANSELDAYGKSDFYKRLIDKAKTVEGVEALKDAILAACP

SEQ ID NO: 1487 - protein, 46 aa, ARTIFICIAL SEQUENCE
  Engineered albumin binding polypeptide
LAEAKCAANSELDAYGCSDFYKRLIDKAKTVEGVEALKDAILAACP

SEQ ID NO: 1488 - protein, 46 aa, ARTIFICIAL SEQUENCE
  Engineered albumin binding polypeptide
LAEAKCAANSELDAYGKSDFYKRLIDKAKTVEGVEALKDAILAAKP

SEQ ID NO: 1489 - protein, 46 aa, ARTIFICIAL SEQUENCE
  Engineered albumin binding polypeptide
LAEAKCSANSELDAYGCSDFYKRLIDKAKTVEGVEALKDAILAAKP

SEQ ID NO: 1490 - protein, 46 aa, ARTIFICIAL SEQUENCE
  Engineered albumin binding polypeptide
LAEAKCSANSELDAYGKSDFYKRLIDKAKTVEGVEALKDAILAACP

SEQ ID NO: 1491 - protein, 46 aa, ARTIFICIAL SEQUENCE
  Engineered albumin binding polypeptide
LAEAKCSANSELDAYGCSDFYKRLIDKAKTVEGVEALKDAILAACP

SEQ ID NO: 1492 - protein, 46 aa, ARTIFICIAL SEQUENCE
  Engineered albumin binding polypeptide
LAEAKCSANSELDAYGKSDFYKRLIDKAKTVEGVEALKDAILAAKP

SEQ ID NO: 1493 - protein, 46 aa, ARTIFICIAL SEQUENCE
  Engineered albumin binding polypeptide
LAEAKCSANAELDAYGCSDFYKRLIDKAKTVEGVEALKDAILAAKP

SEQ ID NO: 1494 - protein, 46 aa, ARTIFICIAL SEQUENCE
  Engineered albumin binding polypeptide
LAEAKCSANAELDAYGKSDFYKRLIDKAKTVEGVEALKDAILAACP

SEQ ID NO: 1495 - protein, 46 aa, ARTIFICIAL SEQUENCE
  Engineered albumin binding polypeptide
LAEAKCSANAELDAYGCSDFYKRLIDKAKTVEGVEALKDAILAACP

SEQ ID NO: 1496 - protein, 46 aa, ARTIFICIAL SEQUENCE
  Engineered albumin binding polypeptide
LAEAKCSANAELDAYGKSDFYKRLIDKAKTVEGVEALKDAILAAKP

SEQ ID NO: 1497 - protein, 46 aa, ARTIFICIAL SEQUENCE
  Engineered albumin binding polypeptide
LAEAKCAANAELDCYGCSDFYKRLIDKAKTVEGVEALKDAILAAKP

SEQ ID NO: 1498 - protein, 46 aa, ARTIFICIAL SEQUENCE
  Engineered albumin binding polypeptide
LAEAKCAANAELDCYGKSDFYKRLIDKAKTVEGVEALKDAILAACP

SEQ ID NO: 1499 - protein, 46 aa, ARTIFICIAL SEQUENCE
  Engineered albumin binding polypeptide
LAEAKCAANAELDCYGCSDFYKRLIDKAKTVEGVEALKDAILAACP

SEQ ID NO: 1500 - protein, 46 aa, ARTIFICIAL SEQUENCE
  Engineered albumin binding polypeptide
LAEAKCAANAELDCYGKSDFYKRLIDKAKTVEGVEALKDAILAAKP

SEQ ID NO: 1501 - protein, 46 aa, ARTIFICIAL SEQUENCE
  Engineered albumin binding polypeptide
LAEAKCAANSELDCYGCSDFYKRLIDKAKTVEGVEALKDAILAAKP

SEQ ID NO: 1502 - protein, 46 aa, ARTIFICIAL SEQUENCE
  Engineered albumin binding polypeptide
LAEAKCAANSELDCYGKSDFYKRLIDKAKTVEGVEALKDAILAACP

SEQ ID NO: 1503 - protein, 46 aa, ARTIFICIAL SEQUENCE
  Engineered albumin binding polypeptide
LAEAKCAANSELDCYGCSDFYKRLIDKAKTVEGVEALKDAILAACP

SEQ ID NO: 1504 - protein, 46 aa, ARTIFICIAL SEQUENCE
  Engineered albumin binding polypeptide
LAEAKCAANSELDCYGKSDFYKRLIDKAKTVEGVEALKDAILAAKP

SEQ ID NO: 1505 - protein, 46 aa, ARTIFICIAL SEQUENCE
  Engineered albumin binding polypeptide
LAEAKCAANAELDSYGCSDFYKRLIDKAKTVEGVEALKDAILAAKP

SEQ ID NO: 1506 - protein, 46 aa, ARTIFICIAL SEQUENCE
  Engineered albumin binding polypeptide
LAEAKCAANAELDSYGKSDFYKRLIDKAKTVEGVEALKDAILAACP

SEQ ID NO: 1507 - protein, 46 aa, ARTIFICIAL SEQUENCE
  Engineered albumin binding polypeptide
LAEAKCAANAELDSYGCSDFYKRLIDKAKTVEGVEALKDAILAACP

SEQ ID NO: 1508 - protein, 46 aa, ARTIFICIAL SEQUENCE
  Engineered albumin binding polypeptide
LAEAKCAANAELDSYGKSDFYKRLIDKAKTVEGVEALKDAILAAKP

SEQ ID NO: 1509 - protein, 46 aa, ARTIFICIAL SEQUENCE
  Engineered albumin binding polypeptide
LAEAKCAANSELDSYGCSDFYKRLIDKAKTVEGVEALKDAILAAKP

SEQ ID NO: 1510 - protein, 46 aa, ARTIFICIAL SEQUENCE
  Engineered albumin binding polypeptide
LAEAKCAANSELDSYGKSDFYKRLIDKAKTVEGVEALKDAILAACP

SEQ ID NO: 1511 - protein, 46 aa, ARTIFICIAL SEQUENCE
  Engineered albumin binding polypeptide
LAEAKCAANSELDSYGCSDFYKRLIDKAKTVEGVEALKDAILAACP

SEQ ID NO: 1512 - protein, 46 aa, ARTIFICIAL SEQUENCE
  Engineered albumin binding polypeptide
LAEAKCAANSELDSYGKSDFYKRLIDKAKTVEGVEALKDAILAAKP

SEQ ID NO: 1513 - protein, 46 aa, ARTIFICIAL SEQUENCE
  Engineered albumin binding polypeptide
LAEAKCSANSELDSYGCSDFYKRLIDKAKTVEGVEALKDAILAAKP

SEQ ID NO: 1514 - protein, 46 aa, ARTIFICIAL SEQUENCE
  Engineered albumin binding polypeptide
LAEAKCSANSELDSYGKSDFYKRLIDKAKTVEGVEALKDAILAACP

SEQ ID NO: 1515 - protein, 46 aa, ARTIFICIAL SEQUENCE
  Engineered albumin binding polypeptide
LAEAKCSANSELDSYGCSDFYKRLIDKAKTVEGVEALKDAILAACP

SEQ ID NO: 1516 - protein, 46 aa, ARTIFICIAL SEQUENCE
  Engineered albumin binding polypeptide
LAEAKCSANSELDSYGKSDFYKRLIDKAKTVEGVEALKDAILAAKP

SEQ ID NO: 1517 - protein, 46 aa, ARTIFICIAL SEQUENCE
  Engineered albumin binding polypeptide
LAEAKCSANAELDSYGCSDFYKRLIDKAKTVEGVEALKDAILAAKP

SEQ ID NO: 1518 - protein, 46 aa, ARTIFICIAL SEQUENCE
  Engineered albumin binding polypeptide
LAEAKCSANAELDSYGKSDFYKRLIDKAKTVEGVEALKDAILAACP

SEQ ID NO: 1519 - protein, 46 aa, ARTIFICIAL SEQUENCE
  Engineered albumin binding polypeptide
LAEAKCSANAELDSYGCSDFYKRLIDKAKTVEGVEALKDAILAACP

SEQ ID NO: 1520 - protein, 46 aa, ARTIFICIAL SEQUENCE
  Engineered albumin binding polypeptide
LAEAKCSANAELDSYGKSDFYKRLIDKAKTVEGVEALKDAILAAKP

SEQ ID NO: 1521 - protein, 46 aa, ARTIFICIAL SEQUENCE
  Engineered albumin binding polypeptide
LAEAKCAANAELDKYGCSDFYKRLIDKAKTVEGVEALKDAILAAKP

SEQ ID NO: 1522 - protein, 46 aa, ARTIFICIAL SEQUENCE
  Engineered albumin binding polypeptide
LAEAKCAANAELDKYGKSDFYKRLIDKAKTVEGVEALKDAILAACP

SEQ ID NO: 1523 - protein, 46 aa, ARTIFICIAL SEQUENCE
  Engineered albumin binding polypeptide
LAEAKCAANAELDKYGCSDFYKRLIDKAKTVEGVEALKDAILAACP

SEQ ID NO: 1524 - protein, 46 aa, ARTIFICIAL SEQUENCE
  Engineered albumin binding polypeptide
LAEAKCAANAELDKYGKSDFYKRLIDKAKTVEGVEALKDAILAAKP

SEQ ID NO: 1525 - protein, 46 aa, ARTIFICIAL SEQUENCE
  Engineered albumin binding polypeptide
LAEAKCAANSELDKYGCSDFYKRLIDKAKTVEGVEALKDAILAAKP

SEQ ID NO: 1526 - protein, 46 aa, ARTIFICIAL SEQUENCE
  Engineered albumin binding polypeptide
LAEAKCAANSELDKYGKSDFYKRLIDKAKTVEGVEALKDAILAACP

SEQ ID NO: 1527 - protein, 46 aa, ARTIFICIAL SEQUENCE
  Engineered albumin binding polypeptide
LAEAKCAANSELDKYGCSDFYKRLIDKAKTVEGVEALKDAILAACP

SEQ ID NO: 1528 - protein, 46 aa, ARTIFICIAL SEQUENCE
  Engineered albumin binding polypeptide
LAEAKCAANSELDKYGKSDFYKRLIDKAKTVEGVEALKDAILAAKP

SEQ ID NO: 1529 - protein, 46 aa, ARTIFICIAL SEQUENCE
  Engineered albumin binding polypeptide
LACAKCAANAELDAYGCSDFYKRLIDKAKTVEGVEALKDAILAAKP

SEQ ID NO: 1530 - protein, 46 aa, ARTIFICIAL SEQUENCE
  Engineered albumin binding polypeptide
LACAKCAANAELDAYGKSDFYKRLIDKAKTVEGVEALKDAILAACP

SEQ ID NO: 1531 - protein, 46 aa, ARTIFICIAL SEQUENCE
  Engineered albumin binding polypeptide
LACAKCAANAELDAYGCSDFYKRLIDKAKTVEGVEALKDAILAACP

SEQ ID NO: 1532 - protein, 46 aa, ARTIFICIAL SEQUENCE
  Engineered albumin binding polypeptide
LACAKCAANAELDAYGKSDFYKRLIDKAKTVEGVEALKDAILAAKP

SEQ ID NO: 1533 - protein, 46 aa, ARTIFICIAL SEQUENCE
  Engineered albumin binding polypeptide
LACAKCAANSELDAYGCSDFYKRLIDKAKTVEGVEALKDAILAAKP

SEQ ID NO: 1534 - protein, 46 aa, ARTIFICIAL SEQUENCE
  Engineered albumin binding polypeptide
LACAKCAANSELDAYGKSDFYKRLIDKAKTVEGVEALKDAILAACP

SEQ ID NO: 1535 - protein, 46 aa, ARTIFICIAL SEQUENCE
  Engineered albumin binding polypeptide
LACAKCAANSELDAYGCSDFYKRLIDKAKTVEGVEALKDAILAACP

SEQ ID NO: 1536 - protein, 46 aa, ARTIFICIAL SEQUENCE
  Engineered albumin binding polypeptide
LACAKCAANSELDAYGKSDFYKRLIDKAKTVEGVEALKDAILAAKP

SEQ ID NO: 1537 - protein, 46 aa, ARTIFICIAL SEQUENCE
  Engineered albumin binding polypeptide
LACAKCSANSELDAYGCSDFYKRLIDKAKTVEGVEALKDAILAAKP

SEQ ID NO: 1538 - protein, 46 aa, ARTIFICIAL SEQUENCE
  Engineered albumin binding polypeptide
LACAKCSANSELDAYGKSDFYKRLIDKAKTVEGVEALKDAILAACP

SEQ ID NO: 1539 - protein, 46 aa, ARTIFICIAL SEQUENCE
  Engineered albumin binding polypeptide
LACAKCSANSELDAYGCSDFYKRLIDKAKTVEGVEALKDAILAACP

SEQ ID NO: 1540 - protein, 46 aa, ARTIFICIAL SEQUENCE
  Engineered albumin binding polypeptide
LACAKCSANSELDAYGKSDFYKRLIDKAKTVEGVEALKDAILAAKP

SEQ ID NO: 1541 - protein, 46 aa, ARTIFICIAL SEQUENCE
  Engineered albumin binding polypeptide
LACAKCSANAELDAYGCSDFYKRLIDKAKTVEGVEALKDAILAAKP

SEQ ID NO: 1542 - protein, 46 aa, ARTIFICIAL SEQUENCE
  Engineered albumin binding polypeptide
LACAKCSANAELDAYGKSDFYKRLIDKAKTVEGVEALKDAILAACP

SEQ ID NO: 1543 - protein, 46 aa, ARTIFICIAL SEQUENCE
  Engineered albumin binding polypeptide
LACAKCSANAELDAYGCSDFYKRLIDKAKTVEGVEALKDAILAACP

SEQ ID NO: 1544 - protein, 46 aa, ARTIFICIAL SEQUENCE
  Engineered albumin binding polypeptide
LACAKCSANAELDAYGKSDFYKRLIDKAKTVEGVEALKDAILAAKP

SEQ ID NO: 1545 - protein, 46 aa, ARTIFICIAL SEQUENCE
  Engineered albumin binding polypeptide
LACAKCAANAELDCYGCSDFYKRLIDKAKTVEGVEALKDAILAAKP

SEQ ID NO: 1546 - protein, 46 aa, ARTIFICIAL SEQUENCE
  Engineered albumin binding polypeptide
LACAKCAANAELDCYGKSDFYKRLIDKAKTVEGVEALKDAILAACP

SEQ ID NO: 1547 - protein, 46 aa, ARTIFICIAL SEQUENCE
  Engineered albumin binding polypeptide
LACAKCAANAELDCYGCSDFYKRLIDKAKTVEGVEALKDAILAACP

SEQ ID NO: 1548 - protein, 46 aa, ARTIFICIAL SEQUENCE
  Engineered albumin binding polypeptide
LACAKCAANAELDCYGKSDFYKRLIDKAKTVEGVEALKDAILAAKP

SEQ ID NO: 1549 - protein, 46 aa, ARTIFICIAL SEQUENCE
  Engineered albumin binding polypeptide
LACAKCAANSELDCYGCSDFYKRLIDKAKTVEGVEALKDAILAAKP

SEQ ID NO: 1550 - protein, 46 aa, ARTIFICIAL SEQUENCE
  Engineered albumin binding polypeptide
LACAKCAANSELDCYGKSDFYKRLIDKAKTVEGVEALKDAILAACP

SEQ ID NO: 1551 - protein, 46 aa, ARTIFICIAL SEQUENCE
  Engineered albumin binding polypeptide
LACAKCAANSELDCYGCSDFYKRLIDKAKTVEGVEALKDAILAACP

SEQ ID NO: 1552 - protein, 46 aa, ARTIFICIAL SEQUENCE
  Engineered albumin binding polypeptide
LACAKCAANSELDCYGKSDFYKRLIDKAKTVEGVEALKDAILAAKP

SEQ ID NO: 1553 - protein, 46 aa, ARTIFICIAL SEQUENCE
  Engineered albumin binding polypeptide
LACAKCAANAELDSYGCSDFYKRLIDKAKTVEGVEALKDAILAAKP

SEQ ID NO: 1554 - protein, 46 aa, ARTIFICIAL SEQUENCE
  Engineered albumin binding polypeptide
LACAKCAANAELDSYGKSDFYKRLIDKAKTVEGVEALKDAILAACP

SEQ ID NO: 1555 - protein, 46 aa, ARTIFICIAL SEQUENCE
  Engineered albumin binding polypeptide
LACAKCAANAELDSYGCSDFYKRLIDKAKTVEGVEALKDAILAACP

SEQ ID NO: 1556 - protein, 46 aa, ARTIFICIAL SEQUENCE
  Engineered albumin binding polypeptide
LACAKCAANAELDSYGKSDFYKRLIDKAKTVEGVEALKDAILAAKP

SEQ ID NO: 1557 - protein, 46 aa, ARTIFICIAL SEQUENCE
  Engineered albumin binding polypeptide
LACAKCAANSELDSYGCSDFYKRLIDKAKTVEGVEALKDAILAAKP

SEQ ID NO: 1558 - protein, 46 aa, ARTIFICIAL SEQUENCE
  Engineered albumin binding polypeptide
LACAKCAANSELDSYGKSDFYKRLIDKAKTVEGVEALKDAILAACP

SEQ ID NO: 1559 - protein, 46 aa, ARTIFICIAL SEQUENCE
  Engineered albumin binding polypeptide
LACAKCAANSELDSYGCSDFYKRLIDKAKTVEGVEALKDAILAACP

SEQ ID NO: 1560 - protein, 46 aa, ARTIFICIAL SEQUENCE
  Engineered albumin binding polypeptide
LACAKCAANSELDSYGKSDFYKRLIDKAKTVEGVEALKDAILAAKP

SEQ ID NO: 1561 - protein, 46 aa, ARTIFICIAL SEQUENCE
  Engineered albumin binding polypeptide
LACAKCSANSELDSYGCSDFYKRLIDKAKTVEGVEALKDAILAAKP

SEQ ID NO: 1562 - protein, 46 aa, ARTIFICIAL SEQUENCE
  Engineered albumin binding polypeptide
LACAKCSANSELDSYGKSDFYKRLIDKAKTVEGVEALKDAILAACP

SEQ ID NO: 1563 - protein, 46 aa, ARTIFICIAL SEQUENCE
  Engineered albumin binding polypeptide
LACAKCSANSELDSYGCSDFYKRLIDKAKTVEGVEALKDAILAACP

SEQ ID NO: 1564 - protein, 46 aa, ARTIFICIAL SEQUENCE
  Engineered albumin binding polypeptide
LACAKCSANSELDSYGKSDFYKRLIDKAKTVEGVEALKDAILAAKP

SEQ ID NO: 1565 - protein, 46 aa, ARTIFICIAL SEQUENCE
  Engineered albumin binding polypeptide
LACAKCSANAELDSYGCSDFYKRLIDKAKTVEGVEALKDAILAAKP

SEQ ID NO: 1566 - protein, 46 aa, ARTIFICIAL SEQUENCE
  Engineered albumin binding polypeptide
LACAKCSANAELDSYGKSDFYKRLIDKAKTVEGVEALKDAILAACP

SEQ ID NO: 1567 - protein, 46 aa, ARTIFICIAL SEQUENCE
  Engineered albumin binding polypeptide
LACAKCSANAELDSYGCSDFYKRLIDKAKTVEGVEALKDAILAACP

SEQ ID NO: 1568 - protein, 46 aa, ARTIFICIAL SEQUENCE
  Engineered albumin binding polypeptide
LACAKCSANAELDSYGKSDFYKRLIDKAKTVEGVEALKDAILAAKP

SEQ ID NO: 1569 - protein, 46 aa, ARTIFICIAL SEQUENCE
  Engineered albumin binding polypeptide
LACAKCAANAELDKYGCSDFYKRLIDKAKTVEGVEALKDAILAAKP

SEQ ID NO: 1570 - protein, 46 aa, ARTIFICIAL SEQUENCE
  Engineered albumin binding polypeptide
LACAKCAANAELDKYGKSDFYKRLIDKAKTVEGVEALKDAILAACP

SEQ ID NO: 1571 - protein, 46 aa, ARTIFICIAL SEQUENCE
  Engineered albumin binding polypeptide
LACAKCAANAELDKYGCSDFYKRLIDKAKTVEGVEALKDAILAACP

SEQ ID NO: 1572 - protein, 46 aa, ARTIFICIAL SEQUENCE
  Engineered albumin binding polypeptide
LACAKCAANAELDKYGKSDFYKRLIDKAKTVEGVEALKDAILAAKP

SEQ ID NO: 1573 - protein, 46 aa, ARTIFICIAL SEQUENCE
  Engineered albumin binding polypeptide
LACAKCAANSELDKYGCSDFYKRLIDKAKTVEGVEALKDAILAAKP

SEQ ID NO: 1574 - protein, 46 aa, ARTIFICIAL SEQUENCE
  Engineered albumin binding polypeptide
LACAKCAANSELDKYGKSDFYKRLIDKAKTVEGVEALKDAILAACP

SEQ ID NO: 1575 - protein, 46 aa, ARTIFICIAL SEQUENCE
  Engineered albumin binding polypeptide
LACAKCAANSELDKYGCSDFYKRLIDKAKTVEGVEALKDAILAACP

SEQ ID NO: 1576 - protein, 46 aa, ARTIFICIAL SEQUENCE
  Engineered albumin binding polypeptide
LACAKCAANSELDKYGKSDFYKRLIDKAKTVEGVEALKDAILAAKP

SEQ ID NO: 1577 - protein, 46 aa, ARTIFICIAL SEQUENCE
  Engineered albumin binding polypeptide
LAEAKEAANRELDSYGCSDFYKRLIDKAKTVEGVEALKDAILAAKP

SEQ ID NO: 1578 - protein, 46 aa, ARTIFICIAL SEQUENCE
  Engineered albumin binding polypeptide
LAEAKEAANRELDSYGKSDFYKRLIDKAKTVEGVEALKDAILAACP

SEQ ID NO: 1579 - protein, 46 aa, ARTIFICIAL SEQUENCE
  Engineered albumin binding polypeptide
LAEAKEAANRELDSYGCSDFYKRLIDKAKTVEGVEALKDAILAACP

SEQ ID NO: 1580 - protein, 46 aa, ARTIFICIAL SEQUENCE
  Engineered albumin binding polypeptide
LAEAKEAANRELDSYGKSDFYKRLIDKAKTVEGVEALKDAILAAKP

SEQ ID NO: 1581 - protein, 46 aa, ARTIFICIAL SEQUENCE
  Engineered albumin binding polypeptide
LAEAKEAANAELDSYGCSDFYKRLIEKAKTVEGVEALKDAILAAKP

SEQ ID NO: 1582 - protein, 46 aa, ARTIFICIAL SEQUENCE
  Engineered albumin binding polypeptide
LAEAKEAANAELDSYGKSDFYKRLIEKAKTVEGVEALKDAILAACP

SEQ ID NO: 1583 - protein, 46 aa, ARTIFICIAL SEQUENCE
  Engineered albumin binding polypeptide
LAEAKEAANAELDSYGCSDFYKRLIEKAKTVEGVEALKDAILAACP

SEQ ID NO: 1584 - protein, 46 aa, ARTIFICIAL SEQUENCE
  Engineered albumin binding polypeptide
LAEAKEAANAELDSYGKSDFYKRLIEKAKTVEGVEALKDAILAAKP

SEQ ID NO: 1585 - protein, 46 aa, ARTIFICIAL SEQUENCE
  Engineered albumin binding polypeptide
LAEAKEAANAELDSYGCSDFYKRLIDKAKTVEGVEALKEAILAAKP

SEQ ID NO: 1586 - protein, 46 aa, ARTIFICIAL SEQUENCE
  Engineered albumin binding polypeptide
LAEAKEAANAELDSYGKSDFYKRLIDKAKTVEGVEALKEAILAACP

SEQ ID NO: 1587 - protein, 46 aa, ARTIFICIAL SEQUENCE
  Engineered albumin binding polypeptide
LAEAKEAANAELDSYGCSDFYKRLIDKAKTVEGVEALKEAILAACP

SEQ ID NO: 1588 - protein, 46 aa, ARTIFICIAL SEQUENCE
  Engineered albumin binding polypeptide
LAEAKEAANAELDSYGKSDFYKRLIDKAKTVEGVEALKEAILAAKP

SEQ ID NO: 1589 - protein, 46 aa, ARTIFICIAL SEQUENCE
  Engineered albumin binding polypeptide
LAEAKEAANAELDSYGCSDFYKRLIEKAKTVEGVEALKEAILAAKP

SEQ ID NO: 1590 - protein, 46 aa, ARTIFICIAL SEQUENCE
  Engineered albumin binding polypeptide
LAEAKEAANAELDSYGKSDFYKRLIEKAKTVEGVEALKEAILAACP

SEQ ID NO: 1591 - protein, 46 aa, ARTIFICIAL SEQUENCE
  Engineered albumin binding polypeptide
LAEAKEAANAELDSYGCSDFYKRLIEKAKTVEGVEALKEAILAACP

SEQ ID NO: 1592 - protein, 46 aa, ARTIFICIAL SEQUENCE
  Engineered albumin binding polypeptide
LAEAKEAANAELDSYGKSDFYKRLIEKAKTVEGVEALKEAILAAKP

SEQ ID NO: 1593 - protein, 46 aa, ARTIFICIAL SEQUENCE
  Engineered albumin binding polypeptide
LAEAKEAANRELDSYGCSDFYKRLIEKAKTVEGVEALKEAILAAKP

SEQ ID NO: 1594 - protein, 46 aa, ARTIFICIAL SEQUENCE
  Engineered albumin binding polypeptide
LAEAKEAANRELDSYGKSDFYKRLIEKAKTVEGVEALKEAILAACP

SEQ ID NO: 1595 - protein, 46 aa, ARTIFICIAL SEQUENCE
  Engineered albumin binding polypeptide
LAEAKEAANRELDSYGCSDFYKRLIEKAKTVEGVEALKEAILAACP

SEQ ID NO: 1596 - protein, 46 aa, ARTIFICIAL SEQUENCE
  Engineered albumin binding polypeptide
LAEAKEAANRELDSYGKSDFYKRLIEKAKTVEGVEALKEAILAAKP

SEQ ID NO: 1597 - protein, 46 aa, ARTIFICIAL SEQUENCE
  Engineered albumin binding polypeptide
LAEAKEAANAELDSYGCSDFYKRLIDKAKTVEGVEALKDAILKAKP

SEQ ID NO: 1598 - protein, 46 aa, ARTIFICIAL SEQUENCE
  Engineered albumin binding polypeptide
LAEAKEAANAELDSYGKSDFYKRLIDKAKTVEGVEALKDAILKACP

SEQ ID NO: 1599 - protein, 46 aa, ARTIFICIAL SEQUENCE
  Engineered albumin binding polypeptide
LAEAKEAANAELDSYGCSDFYKRLIDKAKTVEGVEALKDAILKACP

SEQ ID NO: 1600 - protein, 46 aa, ARTIFICIAL SEQUENCE
  Engineered albumin binding polypeptide
LAEAKEAANAELDSYGKSDFYKRLIDKAKTVEGVEALKDAILKAKP

SEQ ID NO: 1601 - protein, 46 aa, ARTIFICIAL SEQUENCE
  Engineered albumin binding polypeptide
LAEAKEAANAELDSYGCSDFYKRLIDKAKTVEGVEALKDAILASKP

SEQ ID NO: 1602 - protein, 46 aa, ARTIFICIAL SEQUENCE
  Engineered albumin binding polypeptide
LAEAKEAANAELDSYGKSDFYKRLIDKAKTVEGVEALKDAILASCP

SEQ ID NO: 1603 - protein, 46 aa, ARTIFICIAL SEQUENCE
  Engineered albumin binding polypeptide
LAEAKEAANAELDSYGCSDFYKRLIDKAKTVEGVEALKDAILASCP

SEQ ID NO: 1604 - protein, 46 aa, ARTIFICIAL SEQUENCE
  Engineered albumin binding polypeptide
LAEAKEAANAELDSYGKSDFYKRLIDKAKTVEGVEALKDAILASKP

SEQ ID NO: 1605 - protein, 46 aa, ARTIFICIAL SEQUENCE
  Engineered albumin binding polypeptide
LAEAKEAANRELDAYGCSDFYKRLIDKAKTVEGVEALKDAILAAKP

SEQ ID NO: 1606 - protein, 46 aa, ARTIFICIAL SEQUENCE
  Engineered albumin binding polypeptide
LAEAKEAANRELDAYGKSDFYKRLIDKAKTVEGVEALKDAILAACP

SEQ ID NO: 1607 - protein, 46 aa, ARTIFICIAL SEQUENCE
  Engineered albumin binding polypeptide
LAEAKEAANRELDAYGCSDFYKRLIDKAKTVEGVEALKDAILAACP

SEQ ID NO: 1608 - protein, 46 aa, ARTIFICIAL SEQUENCE
  Engineered albumin binding polypeptide
LAEAKEAANRELDAYGKSDFYKRLIDKAKTVEGVEALKDAILAAKP

SEQ ID NO: 1609 - protein, 46 aa, ARTIFICIAL SEQUENCE
  Engineered albumin binding polypeptide
LAEAKEAANAELDAYGCSDFYKRLIEKAKTVEGVEALKDAILAAKP

SEQ ID NO: 1610 - protein, 46 aa, ARTIFICIAL SEQUENCE
  Engineered albumin binding polypeptide
LAEAKEAANAELDAYGKSDFYKRLIEKAKTVEGVEALKDAILAACP

SEQ ID NO: 1611 - protein, 46 aa, ARTIFICIAL SEQUENCE
  Engineered albumin binding polypeptide
LAEAKEAANAELDAYGCSDFYKRLIEKAKTVEGVEALKDAILAACP

SEQ ID NO: 1612 - protein, 46 aa, ARTIFICIAL SEQUENCE
  Engineered albumin binding polypeptide
LAEAKEAANAELDAYGKSDFYKRLIEKAKTVEGVEALKDAILAAKP

SEQ ID NO: 1613 - protein, 46 aa, ARTIFICIAL SEQUENCE
  Engineered albumin binding polypeptide
LAEAKEAANAELDAYGCSDFYKRLIDKAKTVEGVEALKEAILAAKP

SEQ ID NO: 1614 - protein, 46 aa, ARTIFICIAL SEQUENCE
  Engineered albumin binding polypeptide
LAEAKEAANAELDAYGKSDFYKRLIDKAKTVEGVEALKEAILAACP

SEQ ID NO: 1615 - protein, 46 aa, ARTIFICIAL SEQUENCE
  Engineered albumin binding polypeptide
LAEAKEAANAELDAYGCSDFYKRLIDKAKTVEGVEALKEAILAACP

SEQ ID NO: 1616 - protein, 46 aa, ARTIFICIAL SEQUENCE
  Engineered albumin binding polypeptide
LAEAKEAANAELDAYGKSDFYKRLIDKAKTVEGVEALKEAILAAKP

SEQ ID NO: 1617 - protein, 46 aa, ARTIFICIAL SEQUENCE
  Engineered albumin binding polypeptide
LAEAKEAANAELDAYGCSDFYKRLIEKAKTVEGVEALKEAILAAKP

SEQ ID NO: 1618 - protein, 46 aa, ARTIFICIAL SEQUENCE
  Engineered albumin binding polypeptide
LAEAKEAANAELDAYGKSDFYKRLIEKAKTVEGVEALKEAILAACP

SEQ ID NO: 1619 - protein, 46 aa, ARTIFICIAL SEQUENCE
  Engineered albumin binding polypeptide
LAEAKEAANAELDAYGCSDFYKRLIEKAKTVEGVEALKEAILAACP

SEQ ID NO: 1620 - protein, 46 aa, ARTIFICIAL SEQUENCE
  Engineered albumin binding polypeptide
LAEAKEAANAELDAYGKSDFYKRLIEKAKTVEGVEALKEAILAAKP

SEQ ID NO: 1621 - protein, 46 aa, ARTIFICIAL SEQUENCE
  Engineered albumin binding polypeptide
LAEAKEAANRELDAYGCSDFYKRLIEKAKTVEGVEALKEAILAAKP

SEQ ID NO: 1622 - protein, 46 aa, ARTIFICIAL SEQUENCE
  Engineered albumin binding polypeptide
LAEAKEAANRELDAYGKSDFYKRLIEKAKTVEGVEALKEAILAACP

SEQ ID NO: 1623 - protein, 46 aa, ARTIFICIAL SEQUENCE
  Engineered albumin binding polypeptide
LAEAKEAANRELDAYGCSDFYKRLIEKAKTVEGVEALKEAILAACP

SEQ ID NO: 1624 - protein, 46 aa, ARTIFICIAL SEQUENCE
  Engineered albumin binding polypeptide
LAEAKEAANRELDAYGKSDFYKRLIEKAKTVEGVEALKEAILAAKP

SEQ ID NO: 1625 - protein, 46 aa, ARTIFICIAL SEQUENCE
  Engineered albumin binding polypeptide
LAEAKEAANAELDAYGCSDFYKRLIDKAKTVEGVEALKDAILKAKP

SEQ ID NO: 1626 - protein, 46 aa, ARTIFICIAL SEQUENCE
  Engineered albumin binding polypeptide
LAEAKEAANAELDAYGKSDFYKRLIDKAKTVEGVEALKDAILKACP

SEQ ID NO: 1627 - protein, 46 aa, ARTIFICIAL SEQUENCE
  Engineered albumin binding polypeptide
LAEAKEAANAELDAYGCSDFYKRLIDKAKTVEGVEALKDAILKACP

SEQ ID NO: 1628 - protein, 46 aa, ARTIFICIAL SEQUENCE
  Engineered albumin binding polypeptide
LAEAKEAANAELDAYGKSDFYKRLIDKAKTVEGVEALKDAILKAKP

SEQ ID NO: 1629 - protein, 46 aa, ARTIFICIAL SEQUENCE
  Engineered albumin binding polypeptide
LAEAKEAANAELDAYGCSDFYKRLIDKAKTVEGVEALKDAILASKP

SEQ ID NO: 1630 - protein, 46 aa, ARTIFICIAL SEQUENCE
  Engineered albumin binding polypeptide
LAEAKEAANAELDAYGKSDFYKRLIDKAKTVEGVEALKDAILASCP

SEQ ID NO: 1631 - protein, 46 aa, ARTIFICIAL SEQUENCE
  Engineered albumin binding polypeptide
LAEAKEAANAELDAYGCSDFYKRLIDKAKTVEGVEALKDAILASCP

SEQ ID NO: 1632 - protein, 46 aa, ARTIFICIAL SEQUENCE
  Engineered albumin binding polypeptide
LAEAKEAANAELDAYGKSDFYKRLIDKAKTVEGVEALKDAILASKP

SEQ ID NO: 1633 - protein, 46 aa, ARTIFICIAL SEQUENCE
  Engineered albumin binding polypeptide
LAQAKEAANRELDAYGCSDFYKRLIDKAKTVEGVEALKDAILAAKP

SEQ ID NO: 1634 - protein, 46 aa, ARTIFICIAL SEQUENCE
  Engineered albumin binding polypeptide
LAQAKEAANRELDAYGKSDFYKRLIDKAKTVEGVEALKDAILAACP

SEQ ID NO: 1635 - protein, 46 aa, ARTIFICIAL SEQUENCE
  Engineered albumin binding polypeptide
LAQAKEAANRELDAYGCSDFYKRLIDKAKTVEGVEALKDAILAACP

SEQ ID NO: 1636 - protein, 46 aa, ARTIFICIAL SEQUENCE
  Engineered albumin binding polypeptide
LAQAKEAANRELDAYGKSDFYKRLIDKAKTVEGVEALKDAILAAKP

SEQ ID NO: 1637 - protein, 46 aa, ARTIFICIAL SEQUENCE
  Engineered albumin binding polypeptide
LAQAKEAANAELDAYGCSDFYKRLIEKAKTVEGVEALKDAILAAKP

SEQ ID NO: 1638 - protein, 46 aa, ARTIFICIAL SEQUENCE
  Engineered albumin binding polypeptide
LAQAKEAANAELDAYGKSDFYKRLIEKAKTVEGVEALKDAILAACP

SEQ ID NO: 1639 - protein, 46 aa, ARTIFICIAL SEQUENCE
  Engineered albumin binding polypeptide
LAQAKEAANAELDAYGCSDFYKRLIEKAKTVEGVEALKDAILAACP

SEQ ID NO: 1640 - protein, 46 aa, ARTIFICIAL SEQUENCE
  Engineered albumin binding polypeptide
LAQAKEAANAELDAYGKSDFYKRLIEKAKTVEGVEALKDAILAAKP

SEQ ID NO: 1641 - protein, 46 aa, ARTIFICIAL SEQUENCE
  Engineered albumin binding polypeptide
LAQAKEAANAELDAYGCSDFYKRLIDKAKTVEGVEALKEAILAAKP

SEQ ID NO: 1642 - protein, 46 aa, ARTIFICIAL SEQUENCE
  Engineered albumin binding polypeptide
LAQAKEAANAELDAYGKSDFYKRLIDKAKTVEGVEALKEAILAACP

SEQ ID NO: 1643 - protein, 46 aa, ARTIFICIAL SEQUENCE
  Engineered albumin binding polypeptide
LAQAKEAANAELDAYGCSDFYKRLIDKAKTVEGVEALKEAILAACP

SEQ ID NO: 1644 - protein, 46 aa, ARTIFICIAL SEQUENCE
  Engineered albumin binding polypeptide
LAQAKEAANAELDAYGKSDFYKRLIDKAKTVEGVEALKEAILAAKP

SEQ ID NO: 1645 - protein, 46 aa, ARTIFICIAL SEQUENCE
  Engineered albumin binding polypeptide
LAQAKEAANAELDAYGCSDFYKRLIEKAKTVEGVEALKEAILAAKP

SEQ ID NO: 1646 - protein, 46 aa, ARTIFICIAL SEQUENCE
  Engineered albumin binding polypeptide
LAQAKEAANAELDAYGKSDFYKRLIEKAKTVEGVEALKEAILAACP

SEQ ID NO: 1647 - protein, 46 aa, ARTIFICIAL SEQUENCE
  Engineered albumin binding polypeptide
LAQAKEAANAELDAYGCSDFYKRLIEKAKTVEGVEALKEAILAACP

SEQ ID NO: 1648 - protein, 46 aa, ARTIFICIAL SEQUENCE
  Engineered albumin binding polypeptide
LAQAKEAANAELDAYGKSDFYKRLIEKAKTVEGVEALKEAILAAKP

SEQ ID NO: 1649 - protein, 46 aa, ARTIFICIAL SEQUENCE
  Engineered albumin binding polypeptide
LAQAKEAANRELDAYGCSDFYKRLIEKAKTVEGVEALKEAILAAKP

SEQ ID NO: 1650 - protein, 46 aa, ARTIFICIAL SEQUENCE
  Engineered albumin binding polypeptide
LAQAKEAANRELDAYGKSDFYKRLIEKAKTVEGVEALKEAILAACP

SEQ ID NO: 1651 - protein, 46 aa, ARTIFICIAL SEQUENCE
  Engineered albumin binding polypeptide
LAQAKEAANRELDAYGCSDFYKRLIEKAKTVEGVEALKEAILAACP

SEQ ID NO: 1652 - protein, 46 aa, ARTIFICIAL SEQUENCE
  Engineered albumin binding polypeptide
LAQAKEAANRELDAYGKSDFYKRLIEKAKTVEGVEALKEAILAAKP

SEQ ID NO: 1653 - protein, 46 aa, ARTIFICIAL SEQUENCE
  Engineered albumin binding polypeptide
LAQAKEAANAELDAYGCSDFYKRLIDKAKTVEGVEALKDAILKAKP

SEQ ID NO: 1654 - protein, 46 aa, ARTIFICIAL SEQUENCE
  Engineered albumin binding polypeptide
LAQAKEAANAELDAYGKSDFYKRLIDKAKTVEGVEALKDAILKACP

SEQ ID NO: 1655 - protein, 46 aa, ARTIFICIAL SEQUENCE
  Engineered albumin binding polypeptide
LAQAKEAANAELDAYGCSDFYKRLIDKAKTVEGVEALKDAILKACP

SEQ ID NO: 1656 - protein, 46 aa, ARTIFICIAL SEQUENCE
  Engineered albumin binding polypeptide
LAQAKEAANAELDAYGKSDFYKRLIDKAKTVEGVEALKDAILKAKP

SEQ ID NO: 1657 - protein, 46 aa, ARTIFICIAL SEQUENCE
  Engineered albumin binding polypeptide
LAQAKEAANAELDAYGCSDFYKRLIDKAKTVEGVEALKDAILASKP

SEQ ID NO: 1658 - protein, 46 aa, ARTIFICIAL SEQUENCE
  Engineered albumin binding polypeptide
LAQAKEAANAELDAYGKSDFYKRLIDKAKTVEGVEALKDAILASCP

SEQ ID NO: 1659 - protein, 46 aa, ARTIFICIAL SEQUENCE
  Engineered albumin binding polypeptide
LAQAKEAANAELDAYGCSDFYKRLIDKAKTVEGVEALKDAILASCP

SEQ ID NO: 1660 - protein, 46 aa, ARTIFICIAL SEQUENCE
  Engineered albumin binding polypeptide
LAQAKEAANAELDAYGKSDFYKRLIDKAKTVEGVEALKDAILASKP

SEQ ID NO: 1661 - protein, 46 aa, ARTIFICIAL SEQUENCE
  Engineered albumin binding polypeptide
LAQAKEAANRELDSYGCSDFYKRLIDKAKTVEGVEALKDAILAAKP

SEQ ID NO: 1662 - protein, 46 aa, ARTIFICIAL SEQUENCE
  Engineered albumin binding polypeptide
LAQAKEAANRELDSYGKSDFYKRLIDKAKTVEGVEALKDAILAACP

SEQ ID NO: 1663 - protein, 46 aa, ARTIFICIAL SEQUENCE
  Engineered albumin binding polypeptide
LAQAKEAANRELDSYGCSDFYKRLIDKAKTVEGVEALKDAILAACP

SEQ ID NO: 1664 - protein, 46 aa, ARTIFICIAL SEQUENCE
  Engineered albumin binding polypeptide
LAQAKEAANRELDSYGKSDFYKRLIDKAKTVEGVEALKDAILAAKP

SEQ ID NO: 1665 - protein, 46 aa, ARTIFICIAL SEQUENCE
  Engineered albumin binding polypeptide
LAQAKEAANAELDSYGCSDFYKRLIEKAKTVEGVEALKDAILAAKP

SEQ ID NO: 1666 - protein, 46 aa, ARTIFICIAL SEQUENCE
  Engineered albumin binding polypeptide
LAQAKEAANAELDSYGKSDFYKRLIEKAKTVEGVEALKDAILAACP

SEQ ID NO: 1667 - protein, 46 aa, ARTIFICIAL SEQUENCE
  Engineered albumin binding polypeptide
LAQAKEAANAELDSYGCSDFYKRLIEKAKTVEGVEALKDAILAACP

SEQ ID NO: 1668 - protein, 46 aa, ARTIFICIAL SEQUENCE
  Engineered albumin binding polypeptide
LAQAKEAANAELDSYGKSDFYKRLIEKAKTVEGVEALKDAILAAKP

SEQ ID NO: 1669 - protein, 46 aa, ARTIFICIAL SEQUENCE
  Engineered albumin binding polypeptide
LAQAKEAANAELDSYGCSDFYKRLIDKAKTVEGVEALKEAILAAKP

SEQ ID NO: 1670 - protein, 46 aa, ARTIFICIAL SEQUENCE
  Engineered albumin binding polypeptide
LAQAKEAANAELDSYGKSDFYKRLIDKAKTVEGVEALKEAILAACP

SEQ ID NO: 1671 - protein, 46 aa, ARTIFICIAL SEQUENCE
  Engineered albumin binding polypeptide
LAQAKEAANAELDSYGCSDFYKRLIDKAKTVEGVEALKEAILAACP

SEQ ID NO: 1672 - protein, 46 aa, ARTIFICIAL SEQUENCE
  Engineered albumin binding polypeptide
LAQAKEAANAELDSYGKSDFYKRLIDKAKTVEGVEALKEAILAAKP

SEQ ID NO: 1673 - protein, 46 aa, ARTIFICIAL SEQUENCE
  Engineered albumin binding polypeptide
LAQAKEAANAELDSYGCSDFYKRLIEKAKTVEGVEALKEAILAAKP

SEQ ID NO: 1674 - protein, 46 aa, ARTIFICIAL SEQUENCE
  Engineered albumin binding polypeptide
LAQAKEAANAELDSYGKSDFYKRLIEKAKTVEGVEALKEAILAACP

SEQ ID NO: 1675 - protein, 46 aa, ARTIFICIAL SEQUENCE
  Engineered albumin binding polypeptide
LAQAKEAANAELDSYGCSDFYKRLIEKAKTVEGVEALKEAILAACP

SEQ ID NO: 1676 - protein, 46 aa, ARTIFICIAL SEQUENCE
  Engineered albumin binding polypeptide
LAQAKEAANAELDSYGKSDFYKRLIEKAKTVEGVEALKEAILAAKP

SEQ ID NO: 1677 - protein, 46 aa, ARTIFICIAL SEQUENCE
  Engineered albumin binding polypeptide
LAQAKEAANRELDSYGCSDFYKRLIEKAKTVEGVEALKEAILAAKP

SEQ ID NO: 1678 - protein, 46 aa, ARTIFICIAL SEQUENCE
  Engineered albumin binding polypeptide
LAQAKEAANRELDSYGKSDFYKRLIEKAKTVEGVEALKEAILAACP

SEQ ID NO: 1679 - protein, 46 aa, ARTIFICIAL SEQUENCE
  Engineered albumin binding polypeptide
LAQAKEAANRELDSYGCSDFYKRLIEKAKTVEGVEALKEAILAACP

SEQ ID NO: 1680 - protein, 46 aa, ARTIFICIAL SEQUENCE
  Engineered albumin binding polypeptide
LAQAKEAANRELDSYGKSDFYKRLIEKAKTVEGVEALKEAILAAKP

SEQ ID NO: 1681 - protein, 46 aa, ARTIFICIAL SEQUENCE
  Engineered albumin binding polypeptide
LAQAKEAANAELDSYGCSDFYKRLIDKAKTVEGVEALKDAILKAKP

SEQ ID NO: 1682 - protein, 46 aa, ARTIFICIAL SEQUENCE
  Engineered albumin binding polypeptide
LAQAKEAANAELDSYGKSDFYKRLIDKAKTVEGVEALKDAILKACP

SEQ ID NO: 1683 - protein, 46 aa, ARTIFICIAL SEQUENCE
  Engineered albumin binding polypeptide
LAQAKEAANAELDSYGCSDFYKRLIDKAKTVEGVEALKDAILKACP

SEQ ID NO: 1684 - protein, 46 aa, ARTIFICIAL SEQUENCE
  Engineered albumin binding polypeptide
LAQAKEAANAELDSYGKSDFYKRLIDKAKTVEGVEALKDAILKAKP

SEQ ID NO: 1685 - protein, 46 aa, ARTIFICIAL SEQUENCE
  Engineered albumin binding polypeptide
LAQAKEAANAELDSYGCSDFYKRLIDKAKTVEGVEALKDAILASKP

SEQ ID NO: 1686 - protein, 46 aa, ARTIFICIAL SEQUENCE
  Engineered albumin binding polypeptide
LAQAKEAANAELDSYGKSDFYKRLIDKAKTVEGVEALKDAILASCP

SEQ ID NO: 1687 - protein, 46 aa, ARTIFICIAL SEQUENCE
  Engineered albumin binding polypeptide
LAQAKEAANAELDSYGCSDFYKRLIDKAKTVEGVEALKDAILASCP

SEQ ID NO: 1688 - protein, 46 aa, ARTIFICIAL SEQUENCE
  Engineered albumin binding polypeptide
LAQAKEAANAELDSYGKSDFYKRLIDKAKTVEGVEALKDAILASKP

SEQ ID NO: 1689 - protein, 46 aa, ARTIFICIAL SEQUENCE
  Engineered albumin binding polypeptide
LAEAKEAANRELDCYGCSDFYKRLIDKAKTVEGVEALKDAILAAKP

SEQ ID NO: 1690 - protein, 46 aa, ARTIFICIAL SEQUENCE
  Engineered albumin binding polypeptide
LAEAKEAANRELDCYGKSDFYKRLIDKAKTVEGVEALKDAILAACP

SEQ ID NO: 1691 - protein, 46 aa, ARTIFICIAL SEQUENCE
  Engineered albumin binding polypeptide
LAEAKEAANRELDCYGCSDFYKRLIDKAKTVEGVEALKDAILAACP

SEQ ID NO: 1692 - protein, 46 aa, ARTIFICIAL SEQUENCE
  Engineered albumin binding polypeptide
LAEAKEAANRELDCYGKSDFYKRLIDKAKTVEGVEALKDAILAAKP

SEQ ID NO: 1693 - protein, 46 aa, ARTIFICIAL SEQUENCE
  Engineered albumin binding polypeptide
LAEAKEAANAELDCYGCSDFYKRLIEKAKTVEGVEALKDAILAAKP

SEQ ID NO: 1694 - protein, 46 aa, ARTIFICIAL SEQUENCE
  Engineered albumin binding polypeptide
LAEAKEAANAELDCYGKSDFYKRLIEKAKTVEGVEALKDAILAACP

SEQ ID NO: 1695 - protein, 46 aa, ARTIFICIAL SEQUENCE
  Engineered albumin binding polypeptide
LAEAKEAANAELDCYGCSDFYKRLIEKAKTVEGVEALKDAILAACP

SEQ ID NO: 1696 - protein, 46 aa, ARTIFICIAL SEQUENCE
  Engineered albumin binding polypeptide
LAEAKEAANAELDCYGKSDFYKRLIEKAKTVEGVEALKDAILAAKP

SEQ ID NO: 1697 - protein, 46 aa, ARTIFICIAL SEQUENCE
  Engineered albumin binding polypeptide
LAEAKEAANAELDCYGCSDFYKRLIDKAKTVEGVEALKEAILAAKP

SEQ ID NO: 1698 - protein, 46 aa, ARTIFICIAL SEQUENCE
  Engineered albumin binding polypeptide
LAEAKEAANAELDCYGKSDFYKRLIDKAKTVEGVEALKEAILAACP

SEQ ID NO: 1699 - protein, 46 aa, ARTIFICIAL SEQUENCE
  Engineered albumin binding polypeptide
LAEAKEAANAELDCYGCSDFYKRLIDKAKTVEGVEALKEAILAACP

SEQ ID NO: 1700 - protein, 46 aa, ARTIFICIAL SEQUENCE
  Engineered albumin binding polypeptide
LAEAKEAANAELDCYGKSDFYKRLIDKAKTVEGVEALKEAILAAKP

SEQ ID NO: 1701 - protein, 46 aa, ARTIFICIAL SEQUENCE
  Engineered albumin binding polypeptide
LAEAKEAANAELDCYGCSDFYKRLIEKAKTVEGVEALKEAILAAKP

SEQ ID NO: 1702 - protein, 46 aa, ARTIFICIAL SEQUENCE
  Engineered albumin binding polypeptide
LAEAKEAANAELDCYGKSDFYKRLIEKAKTVEGVEALKEAILAACP

SEQ ID NO: 1703 - protein, 46 aa, ARTIFICIAL SEQUENCE
  Engineered albumin binding polypeptide
LAEAKEAANAELDCYGCSDFYKRLIEKAKTVEGVEALKEAILAACP

SEQ ID NO: 1704 - protein, 46 aa, ARTIFICIAL SEQUENCE
  Engineered albumin binding polypeptide
LAEAKEAANAELDCYGKSDFYKRLIEKAKTVEGVEALKEAILAAKP

SEQ ID NO: 1705 - protein, 46 aa, ARTIFICIAL SEQUENCE
  Engineered albumin binding polypeptide
LAEAKEAANRELDCYGCSDFYKRLIEKAKTVEGVEALKEAILAAKP

SEQ ID NO: 1706 - protein, 46 aa, ARTIFICIAL SEQUENCE
  Engineered albumin binding polypeptide
LAEAKEAANRELDCYGKSDFYKRLIEKAKTVEGVEALKEAILAACP

SEQ ID NO: 1707 - protein, 46 aa, ARTIFICIAL SEQUENCE
  Engineered albumin binding polypeptide
LAEAKEAANRELDCYGCSDFYKRLIEKAKTVEGVEALKEAILAACP

SEQ ID NO: 1708 - protein, 46 aa, ARTIFICIAL SEQUENCE
  Engineered albumin binding polypeptide
LAEAKEAANRELDCYGKSDFYKRLIEKAKTVEGVEALKEAILAAKP

SEQ ID NO: 1709 - protein, 46 aa, ARTIFICIAL SEQUENCE
  Engineered albumin binding polypeptide
LAEAKEAANAELDCYGCSDFYKRLIDKAKTVEGVEALKDAILKAKP

SEQ ID NO: 1710 - protein, 46 aa, ARTIFICIAL SEQUENCE
  Engineered albumin binding polypeptide
LAEAKEAANAELDCYGKSDFYKRLIDKAKTVEGVEALKDAILKACP

SEQ ID NO: 1711 - protein, 46 aa, ARTIFICIAL SEQUENCE
  Engineered albumin binding polypeptide
LAEAKEAANAELDCYGCSDFYKRLIDKAKTVEGVEALKDAILKACP

SEQ ID NO: 1712 - protein, 46 aa, ARTIFICIAL SEQUENCE
  Engineered albumin binding polypeptide
LAEAKEAANAELDCYGKSDFYKRLIDKAKTVEGVEALKDAILKAKP

SEQ ID NO: 1713 - protein, 46 aa, ARTIFICIAL SEQUENCE
  Engineered albumin binding polypeptide
LAEAKEAANAELDCYGCSDFYKRLIDKAKTVEGVEALKDAILASKP

SEQ ID NO: 1714 - protein, 46 aa, ARTIFICIAL SEQUENCE
  Engineered albumin binding polypeptide
LAEAKEAANAELDCYGKSDFYKRLIDKAKTVEGVEALKDAILASCP

SEQ ID NO: 1715 - protein, 46 aa, ARTIFICIAL SEQUENCE
  Engineered albumin binding polypeptide
LAEAKEAANAELDCYGCSDFYKRLIDKAKTVEGVEALKDAILASCP

SEQ ID NO: 1716 - protein, 46 aa, ARTIFICIAL SEQUENCE
  Engineered albumin binding polypeptide
LAEAKEAANAELDCYGKSDFYKRLIDKAKTVEGVEALKDAILASKP

SEQ ID NO: 1717 - protein, 45 aa, ARTIFICIAL SEQUENCE
  Engineered albumin binding polypeptide
LAEAKEAANAELDSYGCSDFYKRLIDKAKTVEGVEALKDAILAAK

SEQ ID NO: 1718 - protein, 45 aa, ARTIFICIAL SEQUENCE
  Engineered albumin binding polypeptide
LAEAKEAANAELDSYGKSDFYKRLIDKAKTVEGVEALKDAILAAC

SEQ ID NO: 1719 - protein, 45 aa, ARTIFICIAL SEQUENCE
  Engineered albumin binding polypeptide
LAEAKEAANAELDSYGCSDFYKRLIDKAKTVEGVEALKDAILAAC

SEQ ID NO: 1720 - protein, 45 aa, ARTIFICIAL SEQUENCE
  Engineered albumin binding polypeptide
LAEAKEAANAELDSYGKSDFYKRLIDKAKTVEGVEALKDAILAAK

SEQ ID NO: 1721 - protein, 45 aa, ARTIFICIAL SEQUENCE
  Engineered albumin binding polypeptide
LAEAKEAANAELDAYGCSDFYKRLIDKAKTVEGVEALKDAILAAK

SEQ ID NO: 1722 - protein, 45 aa, ARTIFICIAL SEQUENCE
  Engineered albumin binding polypeptide
LAEAKEAANAELDAYGKSDFYKRLIDKAKTVEGVEALKDAILAAC

SEQ ID NO: 1723 - protein, 45 aa, ARTIFICIAL SEQUENCE
  Engineered albumin binding polypeptide
LAEAKEAANAELDAYGCSDFYKRLIDKAKTVEGVEALKDAILAAC

SEQ ID NO: 1724 - protein, 45 aa, ARTIFICIAL SEQUENCE
  Engineered albumin binding polypeptide
LAEAKEAANAELDAYGKSDFYKRLIDKAKTVEGVEALKDAILAAK

SEQ ID NO: 1725 - protein, 45 aa, ARTIFICIAL SEQUENCE
  Engineered albumin binding polypeptide
LAQAKEAANAELDAYGCSDFYKRLIDKAKTVEGVEALKDAILAAK

SEQ ID NO: 1726 - protein, 45 aa, ARTIFICIAL SEQUENCE
  Engineered albumin binding polypeptide
LAQAKEAANAELDAYGKSDFYKRLIDKAKTVEGVEALKDAILAAC

SEQ ID NO: 1727 - protein, 45 aa, ARTIFICIAL SEQUENCE
  Engineered albumin binding polypeptide
LAQAKEAANAELDAYGCSDFYKRLIDKAKTVEGVEALKDAILAAC

SEQ ID NO: 1728 - protein, 45 aa, ARTIFICIAL SEQUENCE
  Engineered albumin binding polypeptide
LAQAKEAANAELDAYGKSDFYKRLIDKAKTVEGVEALKDAILAAK

SEQ ID NO: 1729 - protein, 45 aa, ARTIFICIAL SEQUENCE
  Engineered albumin binding polypeptide
LAQAKEAANAELDSYGCSDFYKRLIDKAKTVEGVEALKDAILAAK

SEQ ID NO: 1730 - protein, 45 aa, ARTIFICIAL SEQUENCE
  Engineered albumin binding polypeptide
LAQAKEAANAELDSYGKSDFYKRLIDKAKTVEGVEALKDAILAAC

SEQ ID NO: 1731 - protein, 45 aa, ARTIFICIAL SEQUENCE
  Engineered albumin binding polypeptide
LAQAKEAANAELDSYGCSDFYKRLIDKAKTVEGVEALKDAILAAC

SEQ ID NO: 1732 - protein, 45 aa, ARTIFICIAL SEQUENCE
  Engineered albumin binding polypeptide
LAQAKEAANAELDSYGKSDFYKRLIDKAKTVEGVEALKDAILAAK

SEQ ID NO: 1733 - protein, 45 aa, ARTIFICIAL SEQUENCE
  Engineered albumin binding polypeptide
LAEAKEAANAELDCYGCSDFYKRLIDKAKTVEGVEALKDAILAAK

SEQ ID NO: 1734 - protein, 45 aa, ARTIFICIAL SEQUENCE
  Engineered albumin binding polypeptide
LAEAKEAANAELDCYGKSDFYKRLIDKAKTVEGVEALKDAILAAC

SEQ ID NO: 1735 - protein, 45 aa, ARTIFICIAL SEQUENCE
  Engineered albumin binding polypeptide
LAEAKEAANAELDCYGCSDFYKRLIDKAKTVEGVEALKDAILAAC

SEQ ID NO: 1736 - protein, 45 aa, ARTIFICIAL SEQUENCE
  Engineered albumin binding polypeptide
LAEAKEAANAELDCYGKSDFYKRLIDKAKTVEGVEALKDAILAAK

SEQ ID NO: 1737 - protein, 46 aa, ARTIFICIAL SEQUENCE
  Engineered albumin binding polypeptide
LAEAKEAANAELDSYGCSDFYKKLIDKAKTVEGVEALKDAILAAKP

SEQ ID NO: 1738 - protein, 46 aa, ARTIFICIAL SEQUENCE
  Engineered albumin binding polypeptide
LAEAKEAANAELDSYGKSDFYKKLIDKAKTVEGVEALKDAILAACP

SEQ ID NO: 1739 - protein, 46 aa, ARTIFICIAL SEQUENCE
  Engineered albumin binding polypeptide
LAEAKEAANAELDSYGCSDFYKKLIDKAKTVEGVEALKDAILAACP

SEQ ID NO: 1740 - protein, 46 aa, ARTIFICIAL SEQUENCE
  Engineered albumin binding polypeptide
LAEAKEAANAELDSYGKSDFYKKLIDKAKTVEGVEALKDAILAAKP

SEQ ID NO: 1741 - protein, 46 aa, ARTIFICIAL SEQUENCE
  Engineered albumin binding polypeptide
LAEAKEAANAELDSYGCSDFYKKLIDKAKTVEGVEALKDEILAAKP

SEQ ID NO: 1742 - protein, 46 aa, ARTIFICIAL SEQUENCE
  Engineered albumin binding polypeptide
LAEAKEAANAELDSYGKSDFYKKLIDKAKTVEGVEALKDEILAACP

SEQ ID NO: 1743 - protein, 46 aa, ARTIFICIAL SEQUENCE
  Engineered albumin binding polypeptide
LAEAKEAANAELDSYGCSDFYKKLIDKAKTVEGVEALKDEILAACP

SEQ ID NO: 1744 - protein, 46 aa, ARTIFICIAL SEQUENCE
  Engineered albumin binding polypeptide
LAEAKEAANAELDSYGKSDFYKKLIDKAKTVEGVEALKDEILAAKP

SEQ ID NO: 1745 - protein, 46 aa, ARTIFICIAL SEQUENCE
  Engineered albumin binding polypeptide
LAEAKEAANAELDSYGCSDFYKKLIDKAKTVEGVEALKEAILAAKP

SEQ ID NO: 1746 - protein, 46 aa, ARTIFICIAL SEQUENCE
  Engineered albumin binding polypeptide
LAEAKEAANAELDSYGKSDFYKKLIDKAKTVEGVEALKEAILAACP

SEQ ID NO: 1747 - protein, 46 aa, ARTIFICIAL SEQUENCE
  Engineered albumin binding polypeptide
LAEAKEAANAELDSYGCSDFYKKLIDKAKTVEGVEALKEAILAACP

SEQ ID NO: 1748 - protein, 46 aa, ARTIFICIAL SEQUENCE
  Engineered albumin binding polypeptide
LAEAKEAANAELDSYGKSDFYKKLIDKAKTVEGVEALKEAILAAKP

SEQ ID NO: 1749 - protein, 46 aa, ARTIFICIAL SEQUENCE
  Engineered albumin binding polypeptide
LAEAKEAANAELDSYGCSDFYKKLIDKAKTVEGVEALKEEILAAKP

SEQ ID NO: 1750 - protein, 46 aa, ARTIFICIAL SEQUENCE
  Engineered albumin binding polypeptide
LAEAKEAANAELDSYGKSDFYKKLIDKAKTVEGVEALKEEILAACP

SEQ ID NO: 1751 - protein, 46 aa, ARTIFICIAL SEQUENCE
  Engineered albumin binding polypeptide
LAEAKEAANAELDSYGCSDFYKKLIDKAKTVEGVEALKEEILAACP

SEQ ID NO: 1752 - protein, 46 aa, ARTIFICIAL SEQUENCE
  Engineered albumin binding polypeptide
LAEAKEAANAELDSYGKSDFYKKLIDKAKTVEGVEALKEEILAAKP

SEQ ID NO: 1753 - protein, 46 aa, ARTIFICIAL SEQUENCE
  Engineered albumin binding polypeptide
LAEAKEAANAELDSYGCSDFYKKLIEKAKTVEGVEALKDAILAAKP

SEQ ID NO: 1754 - protein, 46 aa, ARTIFICIAL SEQUENCE
  Engineered albumin binding polypeptide
LAEAKEAANAELDSYGKSDFYKKLIEKAKTVEGVEALKDAILAACP

SEQ ID NO: 1755 - protein, 46 aa, ARTIFICIAL SEQUENCE
  Engineered albumin binding polypeptide
LAEAKEAANAELDSYGCSDFYKKLIEKAKTVEGVEALKDAILAACP

SEQ ID NO: 1756 - protein, 46 aa, ARTIFICIAL SEQUENCE
  Engineered albumin binding polypeptide
LAEAKEAANAELDSYGKSDFYKKLIEKAKTVEGVEALKDAILAAKP

SEQ ID NO: 1757 - protein, 46 aa, ARTIFICIAL SEQUENCE
  Engineered albumin binding polypeptide
LAEAKEAANAELDSYGCSDFYKKLIEKAKTVEGVEALKDEILAAKP

SEQ ID NO: 1758 - protein, 46 aa, ARTIFICIAL SEQUENCE
  Engineered albumin binding polypeptide
LAEAKEAANAELDSYGKSDFYKKLIEKAKTVEGVEALKDEILAACP

SEQ ID NO: 1759 - protein, 46 aa, ARTIFICIAL SEQUENCE
  Engineered albumin binding polypeptide
LAEAKEAANAELDSYGCSDFYKKLIEKAKTVEGVEALKDEILAACP

SEQ ID NO: 1760 - protein, 46 aa, ARTIFICIAL SEQUENCE
  Engineered albumin binding polypeptide
LAEAKEAANAELDSYGKSDFYKKLIEKAKTVEGVEALKDEILAAKP

SEQ ID NO: 1761 - protein, 46 aa, ARTIFICIAL SEQUENCE
  Engineered albumin binding polypeptide
LAEAKEAANAELDSYGCSDFYKKLIEKAKTVEGVEALKEAILAAKP

SEQ ID NO: 1762 - protein, 46 aa, ARTIFICIAL SEQUENCE
  Engineered albumin binding polypeptide
LAEAKEAANAELDSYGKSDFYKKLIEKAKTVEGVEALKEAILAACP

SEQ ID NO: 1763 - protein, 46 aa, ARTIFICIAL SEQUENCE
  Engineered albumin binding polypeptide
LAEAKEAANAELDSYGCSDFYKKLIEKAKTVEGVEALKEAILAACP

SEQ ID NO: 1764 - protein, 46 aa, ARTIFICIAL SEQUENCE
  Engineered albumin binding polypeptide
LAEAKEAANAELDSYGKSDFYKKLIEKAKTVEGVEALKEAILAAKP

SEQ ID NO: 1765 - protein, 46 aa, ARTIFICIAL SEQUENCE
  Engineered albumin binding polypeptide
LAEAKEAANAELDSYGCSDFYKKLIEKAKTVEGVEALKEEILAAKP

SEQ ID NO: 1766 - protein, 46 aa, ARTIFICIAL SEQUENCE
  Engineered albumin binding polypeptide
LAEAKEAANAELDSYGKSDFYKKLIEKAKTVEGVEALKEEILAACP

SEQ ID NO: 1767 - protein, 46 aa, ARTIFICIAL SEQUENCE
  Engineered albumin binding polypeptide
LAEAKEAANAELDSYGCSDFYKKLIEKAKTVEGVEALKEEILAACP

SEQ ID NO: 1768 - protein, 46 aa, ARTIFICIAL SEQUENCE
  Engineered albumin binding polypeptide
LAEAKEAANAELDSYGKSDFYKKLIEKAKTVEGVEALKEEILAAKP

SEQ ID NO: 1769 - protein, 46 aa, ARTIFICIAL SEQUENCE
  Engineered albumin binding polypeptide
LAEAKEAANAELDSYGVSDFYKRLIDKCKTVEGVEALKDAILAALP

SEQ ID NO: 1770 - protein, 46 aa, ARTIFICIAL SEQUENCE
  Engineered albumin binding polypeptide
CAEAKEAANAELDSYGVSDFYKRLIDKAKTVEGVEALKDAILAALP

SEQ ID NO: 1771 - protein, 46 aa, ARTIFICIAL SEQUENCE
  Engineered albumin binding polypeptide
LAEAKEAANAELDSYGCSDFYKRLIDKCKTVEGVEALKDAILAAKP

SEQ ID NO: 1772 - protein, 46 aa, ARTIFICIAL SEQUENCE
  Engineered albumin binding polypeptide
CAEAKEAANAELDSYGCSDFYKRLIDKAKTVEGVEALKDAILAAKP

SEQ ID NO: 1773 - protein, 49 aa, ARTIFICIAL SEQUENCE
  Engineered albumin binding polypeptide
GSSLAEAKEAANAELDSYGCSDFYKRLIDKAKTVEGVEALKDAILAACP

SEQ ID NO: 1774 - protein, 46 aa, ARTIFICIAL SEQUENCE
  Engineered albumin binding polypeptide
LAEAKEAANAELDSYGVSDFYKRLIDKAKTVEGVEALKDAILAALP

SEQ ID NO: 1775 - protein, 48 aa, ARTIFICIAL SEQUENCE
  Engineered library/scaffold polypeptide
  misc_feature (2)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(28): Xaa can be any naturally occurring amino acid
EXXXAXXEIXXLPNLTXXQXXAFIXKLXDDPSQSSELLSEAKKLNDSQ

SEQ ID NO: 1776 - protein, 58 aa, ARTIFICIAL SEQUENCE
  Engineered library/scaffold polypeptide
  misc_feature (9)..(11): Xaa can be any naturally occurring amino acid
  misc_feature (13)..(14): Xaa can be any naturally occurring amino acid
  misc_feature (17)..(18): Xaa can be any naturally occurring amino acid
  misc_feature (24)..(25): Xaa can be any naturally occurring amino acid
  misc_feature (27)..(28): Xaa can be any naturally occurring amino acid
  misc_feature (32)..(32): Xaa can be any naturally occurring amino acid
  misc_feature (35)..(35): Xaa can be any naturally occurring amino acid
VDNKFNKEXXXAXXEIXXLPNLNXXQXXAFIXSLXDDPSQSANLLAEAKKLNDAQAPK

SEQ ID NO: 1777 - protein, 48 aa, ARTIFICIAL SEQUENCE
  Engineered library/scaffold polypeptide
  misc_feature (2)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(28): Xaa can be any naturally occurring amino acid
EXXXAXXEIXXLPNLTXXQXXAFIXKLXDDPSQSSELLSEAKKLSESQ

SEQ ID NO: 1778 - protein, 48 aa, ARTIFICIAL SEQUENCE
  Engineered library/scaffold polypeptide
  misc_feature (2)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(28): Xaa can be any naturally occurring amino acid
EXXXAXXEIXXLPNLTXXQXXAFIXKLXDDPSQSSELLSEAKKLESSQ

SEQ ID NO: 1779 - protein, 48 aa, ARTIFICIAL SEQUENCE
  Engineered library/scaffold polypeptide
  misc_feature (2)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(28): Xaa can be any naturally occurring amino acid
EXXXAXXEIXXLPNLTXXQXXAFIXKLXRQPEQSSELLSEAKKLNDSQ

SEQ ID NO: 1780 - protein, 48 aa, ARTIFICIAL SEQUENCE
  Engineered library/scaffold polypeptide
  misc_feature (2)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(28): Xaa can be any naturally occurring amino acid
EXXXAXXEIXXLPNLTXXQXXAFIXKLXRQPEQSSELLSEAKKLSESQ

SEQ ID NO: 1781 - protein, 48 aa, ARTIFICIAL SEQUENCE
  Engineered library/scaffold polypeptide
  misc_feature (2)..(4): Xaa can be any naturally occurring amino acid
  misc_feature (6)..(7): Xaa can be any naturally occurring amino acid
  misc_feature (10)..(11): Xaa can be any naturally occurring amino acid
  misc_feature (17)..(18): Xaa can be any naturally occurring amino acid
  misc_feature (20)..(21): Xaa can be any naturally occurring amino acid
  misc_feature (25)..(25): Xaa can be any naturally occurring amino acid
  misc_feature (28)..(28): Xaa can be any naturally occurring amino acid
EXXXAXXEIXXLPNLTXXQXXAFIXKLXRQPEQSSELLSEAKKLESSQ

SEQ ID NO: 1782 - protein, 31 aa, Artificial Sequence
  Albumin binding polypeptide
  MISC_FEATURE (2)..(2): Xaa is selected from C and K, K is optionally functionalized
  MISC_FEATURE (5)..(5): Xaa is selected from F and Y
  MISC_FEATURE (8)..(8): Xaa is selected from D, K, N, R, and S
  MISC_FEATURE (9)..(9): Xaa is selected from F, I, L, M, V, and Y
  MISC_FEATURE (11)..(11): Xaa is selected from D, E, N, and S
  MISC_FEATURE (12)..(12): Xaa is selected from K, N, and R
  MISC_FEATURE (14)..(14): Xaa is selected from K and R
  MISC_FEATURE (20)..(20): Xaa is selected from D, E, H, K, N, Q, R, and S
  MISC_FEATURE (23)..(23): Xaa is selected from I, K, and T
  MISC_FEATURE (24)..(24): Xaa is selected from A, D, E, G, H, L, S, and T
  MISC_FEATURE (25)..(25): Xaa is selected from A, D, E, and H
  MISC_FEATURE (28)..(28): Xaa is selected from A and K
  MISC_FEATURE (29)..(29): Xaa is selected from A, E, and S
  MISC_FEATURE (30)..(30): Xaa is selected from C and K, K is optionally functionalized
  MISC_FEATURE (31)..(31): Xaa is P or is absent
GXSDXYKXXIXXAXTVEGVXALXXXILXXXX

SEQ ID NO: 1783 - protein, 15 aa, Artificial Sequence
  Albumin binding polypeptide
  MISC_FEATURE (3)..(3): Xaa is selected from C, E, Q, and S
  MISC_FEATURE (6)..(6): Xaa is selected from C, E, S, and V
  MISC_FEATURE (7)..(7): Xaa is selected from A, D, E, L, and S
  MISC_FEATURE (9)..(9): Xaa is selected from I, N, and L
  MISC_FEATURE (10)..(10): Xaa is selected from A, K, R, and S
  MISC_FEATURE (13)..(13): Xaa is selected from D and K
  MISC_FEATURE (14)..(14): Xaa is selected from A, C, K, and S
  MISC_FEATURE (15)..(15): albumin binding motif
LAXAKXXAXXELXXY

The invention claimed is:

1. An albumin binding polypeptide comprising an albumin binding motif [ABM], which motif consists of the amino acid sequence $$GX_4SDX_5YKX_8X_9I\ X_{11}X_{12}AX_{14}TVEGVX_{20}\ ALX_{23}X_{24}X_{25}ILX_{28}X_{29}X_BX31$$
(SEQ ID NO: 1782)

wherein, independently from each other,
$X_A$ is selected from C and optionally functionalized K;
$X_B$ is selected from C and optionally functionalized K; and
$X_5$ is selected from F and Y;
$X_8$ is selected from D, K, N, R and S;
$X_9$ is selected from F, I, L, M, V and Y;
$X_{11}$ is selected from D, E, N and S;
$X_{12}$ is selected from K, N and R;
$X_{14}$ is selected from K and R;
$X_{20}$ is selected from D, E, H, K, N, Q, R and S;
$X_{23}$ is selected from I, K and T;
$X_{24}$ is selected from A, D, E, G, H, L, S and T;
$X_{25}$ is selected from A, D, E and H;
$X_{28}$ is selected from A and K;
$X_{29}$ is selected from A, E and S; and
$X_{31}$ is P or is absent; and
wherein the amino acid sequence optionally contains an intramolecular crosslink.

2. The albumin binding polypeptide according to claim 1, wherein $X_A$ is C and $X_B$ is K.

3. The albumin binding polypeptide according to claim 1, wherein $X_A$ is C and $X_B$ is C.

4. The albumin binding polypeptide according to claim 1, wherein $X_{31}$ is absent.

5. The albumin binding polypeptide according to claim 1, wherein $X_{31}$ is P.

6. The albumin binding polypeptide according to claim 1, in which the [ABM] consists of position 16 to position 45 in the amino acid sequence selected from the group consisting of SEQ ID NO:1-1768.

7. The albumin binding polypeptide according to claim 1, in which said albumin binding motif forms part of a three-helix bundle protein domain.

8. The albumin binding polypeptide according to claim 7, in which said three-helix bundle protein domain is selected from the group consisting of domain GA1, domain GA2 and domain GA3 of protein G from *Streptococcus* strain G148.

9. The albumin binding polypeptide according to claim 7, which comprises the amino acid sequence:

$$LAX_aAKX_bX_cAX_dX_eELX_fX_gY-[ABM]$$
(SEQ ID NO. 1783)

wherein
[ABM] is an albumin binding motif as defined in claim 1, and, independently of each other,
$X_a$ is selected from C, E, Q and S;
$X_b$ is selected from C, E, S and V;
$X_c$ is selected from A, D, E, L and S;
$X_d$ is selected from I, N and L;
$X_e$ is selected from A, K, R and S;
$X_f$ is selected from D and K; and
$X_g$ is selected from A, C, K and S.

10. The albumin binding polypeptide according to claim 1, which comprises the amino acid sequence selected from the group consisting of SEQ ID NO:1-1768.

11. The albumin binding polypeptide according to claim 1, wherein $N_A$ is K or $X_B$ is K, and the K is functionalized.

12. The albumin binding polypeptide according to claim 1, wherein said amino acid sequence is crosslinked.

13. The albumin binding polypeptide according to claim 12, wherein said crosslink extends between the amino acid residue in position $X_A$ and the amino acid residue in position $X_B$.

14. The albumin binding polypeptide according to claim 12, wherein said polypeptide is resistant to proteolytic cleavage by at least one protease of the gastrointestinal tract.

15. The albumin binding polypeptide according to claim 1, which binds to albumin such that the $K_D$ value of the interaction is at most $1\times10^{-8}$ M.

16. The albumin binding polypeptide according to claim 1, wherein said albumin is human serum albumin.

17. A compound comprising:
at least one moiety (I) which is an albumin binding polypeptide according to claim 1;
one moiety (II) which confers a desired therapeutic activity; and
optionally, at least one further moiety (III) which confers a desired therapeutic activity, which activity may be the same or different from said activity of moiety (II).

18. A pharmaceutical composition, comprising a compound according to claim 17 and at least one pharmaceutically acceptable excipient.

19. The pharmaceutical composition according to claim 18, which further comprises at least one component for increasing oral bioavailability of said therapeutic activity.

* * * * *

UNITED STATES PATENT AND TRADEMARK OFFICE
CERTIFICATE OF CORRECTION

Page 1 of 1

PATENT NO. : 10,167,322 B2
APPLICATION NO. : 15/104070
DATED : January 1, 2019
INVENTOR(S) : Caroline Ekblad et al.

It is certified that error appears in the above-identified patent and that said Letters Patent is hereby corrected as shown below:

In the Specification

Column 5, Line 41, "$X_5$" should read -- $X_8$ --

Column 6, Lines 49-55, each instance of "$X_5$" should read -- $X_8$ --

In the Claims

Column 48, Line 31, (approx.), Claim 11, "$N_4$" should read -- $X_A$ --

Signed and Sealed this
Twenty-ninth Day of October, 2019

Andrei Iancu
*Director of the United States Patent and Trademark Office*